(12) United States Patent
Revets et al.

(10) Patent No.: US 8,975,382 B2
(45) Date of Patent: Mar. 10, 2015

(54) AMINO ACID SEQUENCES DIRECTED AGAINST HER2 AND POLYPEPTIDES COMPRISING THE SAME FOR THE TREATMENT OF CANCERS AND/OR TUMORS

(75) Inventors: Hilde Adi Pierrette Revets, Meise (BE); Carlo Boutton, Wielsbeke (BE); Hendricus Renerus Jacobus Mattheus Hoogenboom, Maastricht (NL)

(73) Assignee: Ablynx N.V., Zwijnaarde (BE)

( * ) Notice: Subject to any disclaimer, the term of this patent is extended or adjusted under 35 U.S.C. 154(b) by 696 days.

(21) Appl. No.: 12/744,991

(22) PCT Filed: Nov. 27, 2008

(86) PCT No.: PCT/EP2008/066363
§ 371 (c)(1),
(2), (4) Date: Oct. 20, 2010

(87) PCT Pub. No.: WO2009/068625
PCT Pub. Date: Jun. 4, 2009

(65) Prior Publication Data
US 2011/0059090 A1    Mar. 10, 2011

Related U.S. Application Data

(60) Provisional application No. 61/004,332, filed on Nov. 27, 2007, provisional application No. 61/005,265, filed on Dec. 4, 2007, provisional application No. 61/005,324, filed on Dec. 4, 2007, provisional application No. 61/005,331, filed on Dec. 4, 2007.

(51) Int. Cl.
| | |
|---|---|
| *C07K 16/30* | (2006.01) |
| *C07K 16/32* | (2006.01) |
| *C07K 16/46* | (2006.01) |
| *C07K 16/28* | (2006.01) |

(52) U.S. Cl.
CPC ........... *C07K 16/468* (2013.01); *C07K 16/2863* (2013.01); *C07K 16/3007* (2013.01); *C07K 16/32* (2013.01); *C07K 2317/22* (2013.01); *C07K 2317/31* (2013.01); *C07K 2317/569* (2013.01); *C07K 2317/64* (2013.01); *C07K 2319/00* (2013.01); *C07K 2317/52* (2013.01)
USPC .................. 530/388.8; 530/387.3; 530/387.7; 530/388.22

(58) Field of Classification Search
CPC .. C07K 16/468; C07K 16/32; C07K 16/2863; C07K 2317/569
See application file for complete search history.

(56) References Cited

U.S. PATENT DOCUMENTS

| | | | |
|---|---|---|---|
| 5,821,337 A | 10/1998 | Carter et al. | |
| 6,818,749 B1 * | 11/2004 | Kashmiri et al. | ........ 530/388.85 |
| 7,612,181 B2 | 11/2009 | Wu et al. | |
| 2005/0266000 A1 * | 12/2005 | Bond et al. | ................. 424/143.1 |
| 2010/0135998 A1 | 6/2010 | Bowman et al. | |
| 2011/0028695 A1 | 2/2011 | Revets et al. | |
| 2011/0053865 A1 | 3/2011 | Saunders et al. | |
| 2011/0189203 A1 | 8/2011 | Hermans et al. | |

FOREIGN PATENT DOCUMENTS

| | | |
|---|---|---|
| EP | 0 433 827 A2 | 12/1990 |
| EP | 0 698 097 A1 | 2/1996 |
| EP | 0 790 308 A1 | 8/1997 |
| EP | 0 790 309 A1 | 8/1997 |
| EP | 0 969 867 A2 | 1/2000 |
| EP | 1 002 084 A1 | 5/2000 |
| EP | 1 175 446 A1 | 1/2002 |
| EP | 1 210 434 A2 | 6/2002 |
| EP | 1 309 692 A2 | 5/2003 |
| EP | 1 433 793 A1 | 6/2004 |
| EP | 1 498 427 A1 | 1/2005 |
| EP | 1 500 665 A1 | 1/2005 |
| EP | 1 587 178 A1 | 10/2005 |
| EP | 1 589 998 A2 | 11/2005 |
| EP | 1 601 695 A1 | 12/2005 |
| EP | 1 621 554 A1 | 2/2006 |
| JP | 2006/512895 | 4/2006 |
| WO | WO 94/04678 A1 | 3/1994 |
| WO | WO 96/34103 A1 | 10/1996 |
| WO | WO 99/42077 A2 | 8/1999 |
| WO | WO0100245 A2 * | 1/2001 |
| WO | WO 01/77342 A1 | 10/2001 |
| WO | WO 02/09748 A1 | 2/2002 |
| WO | WO 02/056910 A1 | 7/2002 |
| WO | WO 2004/003019 A2 | 1/2004 |
| WO | WO 2004/008099 A2 | 1/2004 |
| WO | WO 2004/041862 A2 | 5/2004 |
| WO | WO 2004/041863 A2 | 5/2004 |

(Continued)

OTHER PUBLICATIONS

De Genst et al., Dev Comp Immunol 2006; 30:187-98.*
MacCallum et al., J Mol Biol. 1996; 262:732-745.*
Rudikoff et al., Proc. Nat'l Acad. Sci. USA 1982; 79:1979-83.*
Brown et al., J. Immunol. 1996; 156(9):3285-91.*
Teulon et al., Poster 121, Eur. H. Cancer Supplements, 4(12):40, Nov. 8, 2006.*
Roovers et al., Cancer Immunol Immunother 2007; 56:303-317.*
Badache et al., A new therapeutic antibody masks ErbB2 to its partners. Cancer Cell. Apr. 2004;5(4):299-301.

(Continued)

*Primary Examiner* — Sheela J Huff
*Assistant Examiner* — Jessica H Roark
(74) *Attorney, Agent, or Firm* — Wolf, Greenfield & Sacks, P.C.

(57) ABSTRACT

The present invention relates to amino acid sequences and Nanobodies that are directed against Epidermal Growth Factor Receptor 2 (HER2), as well as to compounds or constructs, and in particular proteins and polypeptides, that comprise or essentially consist of one or more such amino acid sequences.

16 Claims, 45 Drawing Sheets

(56) References Cited

FOREIGN PATENT DOCUMENTS

Figure 1A:
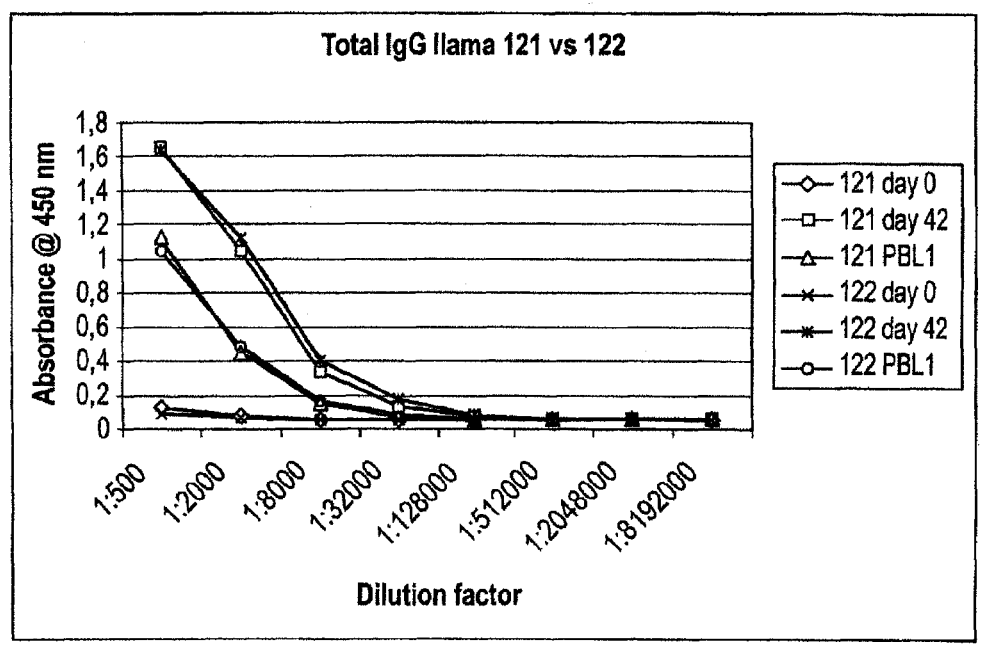
Figure 1B:
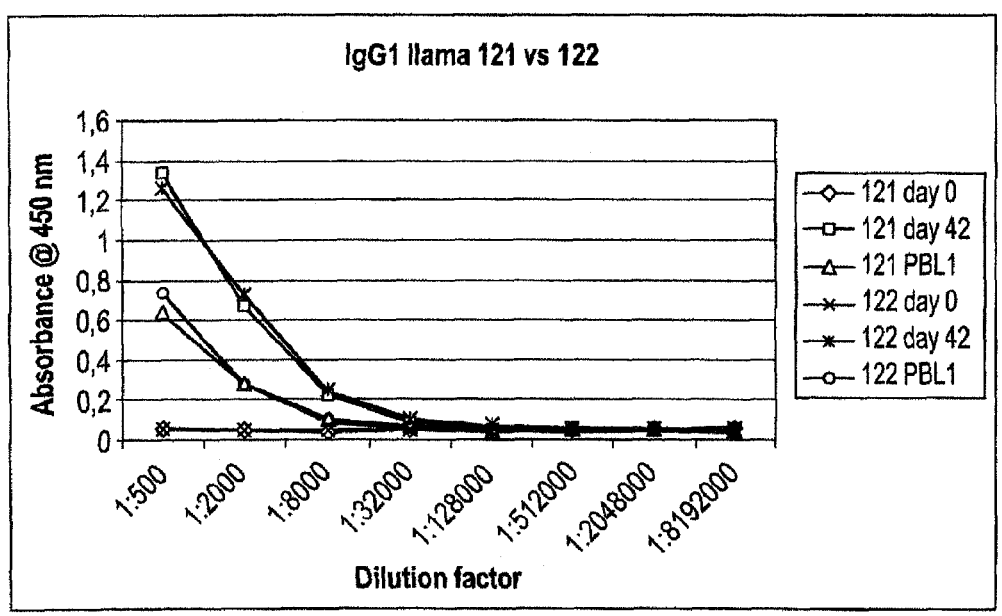
Figure 1C:
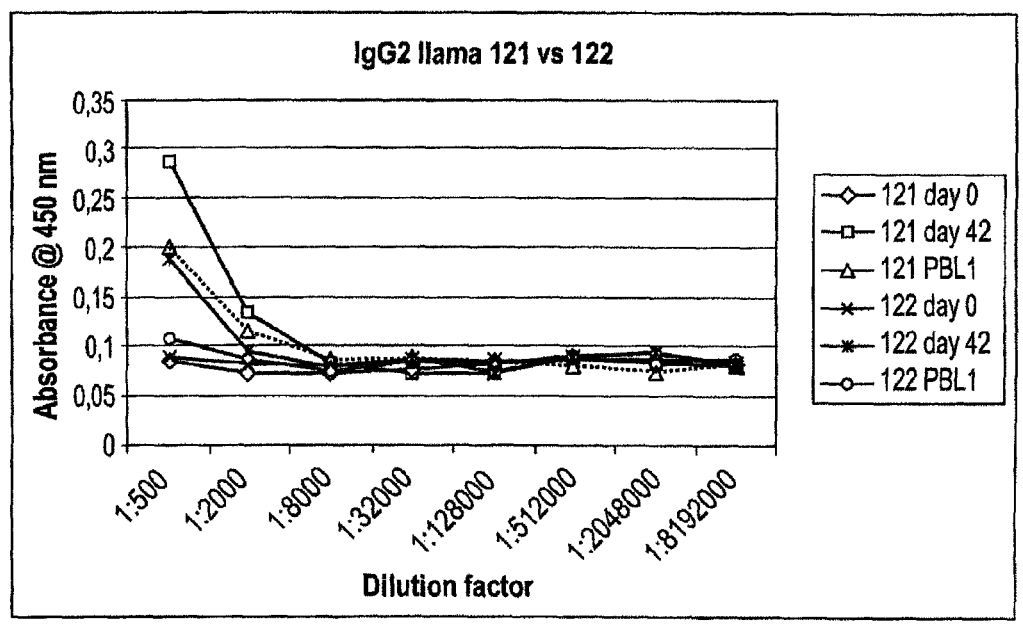
Figure 1D:
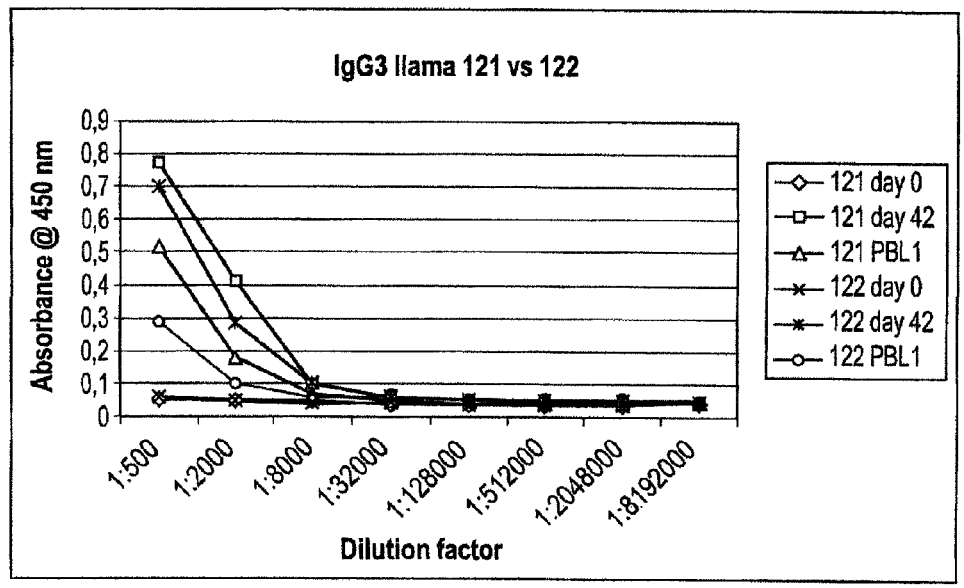

| | | |
|---|---|---|
| WO | WO 2004/058820 A2 | 7/2004 |
| WO | WO 2004/068820 A2 | 8/2004 |
| WO | WO 2004/071517 A2 | 8/2004 |
| WO | WO 2005/018629 A1 | 3/2005 |
| WO | WO 2005/079837 A1 | 9/2005 |
| WO | WO 2006/003388 A2 | 1/2006 |
| WO | WO 2006/008548 A2 | 1/2006 |
| WO | WO 2006/020258 A2 | 2/2006 |
| WO | WO 2006/030220 A1 | 3/2006 |
| WO | WO 2006/040153 A2 | 4/2006 |
| WO | WO 2006/068987 A2 | 6/2006 |
| WO | WO 2006/069036 A2 | 6/2006 |
| WO | WO 2006/122825 A2 | 11/2006 |
| WO | WO 2007/005608 A2 | 1/2007 |
| WO | WO 2007/024715 A2 | 3/2007 |
| WO | WO 2007/024846 A2 | 3/2007 |
| WO | WO 2007/027761 A2 | 3/2007 |
| WO | WO 2007/042289 A2 | 4/2007 |
| WO | WO 2007042289 A2 * | 4/2007 |
| WO | WO 2007/076524 A2 | 7/2007 |
| WO | WO 2007/085814 A1 | 8/2007 |
| WO | WO 2007/118670 A1 | 10/2007 |
| WO | WO 2008/068280 A1 | 6/2008 |
| WO | WO2010066836 A2 * | 6/2010 |

OTHER PUBLICATIONS

Cho HS et al., Structure of the extracellular region of HER2 alone and in complex with the Herceptin Fab. Nature. Feb. 13, 2003;421(6924):756-60.

Citri et al., The deaf and the dumb: the biology of ErbB-2 and ErbB-3. Exp Cell Res. Mar. 10, 2003;284(1):54-65. Review.

Hudziak et al., p185HER2 monoclonal antibody has antiproliferative effects in vitro and human breast tumor cells to tumor necrosis factor. Mol Cell Biol. Mar. 1989;9(3):1165-72.

Hynes et al., ErbB receptors and cancer: the complexity of targeted inhibitors. Nat Rev Cancer. May 2005;5(5):341-54. Review. Erratum in: Nat Rev Cancer. Jul. 2005;5(7):580.

McKeage et al., Trastuzumab: a review of its use in the treatment of metastatic breast cancer overexpressing HER2. Drugs. 2002;62(1):209-43. Review.

Robert et al., Tumor targeting with newly designed biparatopic antibodies directed against two different epitopes of the carcinoembryonic antigen (CEA). Int J Cancer. Apr. 12, 1999;81(2):285-91.

Roskoski, The ErbB/HER receptor protein-tyrosine kinases and cancer. Biochem Biophys Res Commun Jun. 18, 2004;319(1):1-11. Review.

Cheong et al., Affinity enhancement of bispecific antibody against two different epitopes in the same antigen. Biochem Biophys Res Commun. Dec. 31, 1990;173(3):795-800.

Tso et al., Preparation of a bispecific F(ab')2 targeted to the human IL-2 receptor. J Hematother. Oct. 1995;4(5):389-94.

Yang et al., Immunochemical studies on beta1-bungarotoxin. Zoological Studies. 2000;39(2):79-90.

Aggarwal et al., Interleukin-23 promotes a distinct CD4 T cell activation state characterized by the production of interleukin-17. J Biol Chem. Jan. 17, 2003;278(3):1910-4. Epub Nov. 3, 2002.

Agus et al., Targeting ligand-activated ErbB2 signaling inhibits breast and prostate tumor growth. Cancer Cell. Aug. 2002;2(2):127-37.

Boulay et al., Molecular phylogeny within type I cytokines and their cognate receptors. Immunity. Aug. 2003;19(2):159-63.

Carter, Potent antibody therapeutics by design. Nat Rev Immunol. May 2006;6(5):343-57.

Colgan et al., All in the family: IL-27 suppression of $T_H$-17 cells. Nat Immunol. Sep. 2006;7(9):899-901.

Collison et al., The inhibitory cytokine IL-35 contributes to regulatory T-cell function. Nature. Nov. 22, 2007;450(7169):566-9.

Cooper, IL-23 and IL-17 have a multi-faceted largely negative role in fungal infection. Eur J Immunol. Oct. 2007;37(10):2680-2.

Coppieters et al., Formatted anti-tumor necrosis factor alpha VHH proteins derived from camelids show superior potency and targeting to inflamed joints in a murine model of collagen-induced arthritis. Arthritis Rheum. Jun. 2006;54(6):1856-66.

Els Conrath et al., Camel single-domain antibodies as modular building units in bispecific and bivalent antibody constructs. J Biol Chem. Mar. 9, 2001;276(10):7346-50. Epub Oct. 25, 2000.

Franklin et al., Insights into ErbB signaling from the structure of the ErbB2-pertuzumab complex. Cancer Cell. Apr. 2004;5(4):317-28.

Goriely et al., The interleukin-12 family: new players in transplantation immunity? Am J Transplant. Feb. 2007;7(2):278-84. Epub Jan. 4, 2007.

Gould et al., Comparison of IgE and IgG antibody-dependent cytotoxicity in vitro and in a SCID mouse xenograft model of ovarian carcinoma. Eur J Immunol. Nov. 1999;29(11):3527-37.

Gubler et al., Coexpression of two distinct genes is required to generate secreted bioactive cytotoxic lymphocyte maturation factor. Proc Natl Acad Sci U S A. May 15, 1991;88(10):4143-7.

Halaby et al., The immunoglobulin fold family: sequence analysis and 3D structure comparisons. Protein Eng. Jul. 1999;12(7):563-71.

Hamers-Casterman et al., Naturally occurring antibodies devoid of light chains. Nature. Jun. 3, 1993;363(6428):446-8.

Holliger et al., Engineered antibody fragments and the rise of single domains. Nat Biotechnol. Sep. 2005;23(9):1126-36.

Holt et al., Domain antibodies: proteins for therapy. Trends Biotechnol. Nov. 2003;21(11):484-90.

Hunter, New IL-12-family members: IL-23 and IL-27, cytokines with divergent functions. Nat. Rev Immunol. Jul. 2005;5(7):521-31.

Im et al., Generation of a rabbit $V_H$ domain antibody polyspecific to c-Met and adenoviral knob protein. Biochem Biophys Res Commun. Jan. 6, 2006;339(1):305-12. Epub Nov. 15, 2005.

Karagiannis et al., IgE-antibody-dependent immunotherapy of solid tumors: cytotoxic and phagocytic mechanisms of eradication of ovarian cancer cells. J Immunol. Sep. 1, 2007;179(5):2832-43.

Kauffman et al., A phase I study evaluating the safety, pharmacokinetics, and clinical response of a human IL-12 p40 antibody in subjects with plaque psoriasis. J Invest Dermatol. Dec. 2004;123(6):1037-44.

Kikly et al., The IL-23/Th(17) axis: therapeutic targets for autoimmune inflammation. Curr Opin Immunol. Dec. 2006;18(6):670-5. Epub Sep. 28, 2006.

Kortt et al., Dimeric and trimeric antibodies: high avidity scFvs for cancer targeting. Biomol Eng. Oct. 15, 2001;18(3):95-108.

Langrish et al., IL-12 and IL-23: master regulators of innate and adaptive immunity. Immunol Rev. Dec. 2004;202:96-105.

McGuinness et al., Phage diabody repertoires for selection of large numbers of bispecific antibody fragments. Nat Biotechnol. Sep. 1996;14(9):1149-54.

Muyldermans, Single domain camel antibodies: current status. J Biotechnol. Jun. 2001;74(4):277-302.

Neurath, IL-23: a master regulator in Crohn disease. Nat Med. Jan. 2007;13(1):26-8.

Oppmann et al., Novel p19 protein engages IL-12p40 to form a cytokine, IL-23, with biological activities similar as well as distinct from IL-12. Immunity. Nov. 2000;13(5):715-25.

Parham et al., A receptor for the heterodimeric cytokine IL-23 is composed of IL-12Rbeta1 and a novel cytokine receptor subunit, IL-23R. J Immunol. Jun. 1, 2002;168(11):5699-708.

Riemer et al., Active induction of tumor-specific IgE antibodies by oral mimotope vaccination. Cancer Res. Apr. 1, 2007;67(7):3406-11.

Robinson et al., Targeting ErbB2 and ErbB3 with a bispecific single-chain Fv enhances targeting selectivity and induces a therapeutic effect in vitro. Br J Cancer. Nov. 4, 2008;99(9):1415-25. Epub Oct. 7, 2008.

Roovers et al., Nanobodies in therapeutic applications. Curr Opin Mol Ther. Aug. 2007;9(4):327-35.

Shen et al., Single variable domain antibody as a versatile building block for the construction of IgG-like bispecific antibodies. J Immunol Methods. Jan. 10, 2007;318(1-2):65-74. Epub Oct. 26, 2006.

(56) References Cited

OTHER PUBLICATIONS

Stone et al., A novel pentamer versus pentamer approach to generating neutralizers of verotoxin 1. Mol Immunol. Mar. 2007;44(9):2487-91. Epub Nov. 28, 2006.

Veldman, Anti-IL 12p40 antibody development and clinical data in Crohn's disease. IBC Antibody Therapeutics. Presentation given Dec. 7, 2005. 31 pages.

Veldman, Targeting the p40 cytokines interleukin (IL)-12 and IL-23 in Crohn's disease. Drug Discov Today Ther Strateg. 2006;3(3):375-380.

Ward et al., Binding activities of a repertoire of single immunoglobulin variable domains secreted from *Escherichia coli*. Nature. Oct. 12, 1989;341(6242):544-6.

Watford et al., The biology of IL-12: coordinating innate and adaptive immune responses. Cytokine Growth Factor Rev. Oct. 2003;14(5):361-8.

Wu et al., Simultaneous targeting of multiple disease mediators by a dual-variable-domain immunoglobulin. Nat Biotechnol. Nov. 2007;25(11):1290-7. Epub Oct. 14, 2007.

* cited by examiner

Biparatopic Nanobodies : Increasing the potency
of a Herceptin-competing Nanobody (1)

▼ Approach : Combine Herceptin-competing Nanobody with library of
HER2-binding Nanobodies and selecting suitable partner that
antagonizes with *higher potency*

X-ray structure of Herceptin-Fab in
complex with HER-2 (pdb1n8z)

Model of Nb-2D3 docked of HER-2

Biparatopic Nanobodies : Increasing the potency of a Herceptin-competing Nanobody (1)

▼ Approach : Combine Herceptin-competing Nanobody with library of HER2-binding Nanobodies and selecting suitable partner that antagonizes with *higher potency*

X-ray structure of Herceptin-Fab in complex with HER-2 (pdb1n8z)

Model of Nb-2D3 linked to another Nb docked of HER-2

Biparatopic Nanobodies : Increasing the potency
of a Herceptin-competing Nanobody (1)

▼ Approach : Combine Herceptin-competing Nanobody with library of
HER2-binding Nanobodies and selecting suitable partner that
antagonizes with *higher potency*

X-ray structure of Herceptin-Fab in
complex with HER-2 (pdb1n8z)

Model of Nb-2D3 linked to another Nb
docked of HER-2

Figure 27D

Biparatopic Nanobodies : Increasing the potency of a Herceptin-competing Nanobody (2)

*N-terminal* : library of Nbs from SKBR3 Immunized llama selected on rhErbB2/Fc via Herceptin capturing (epitope masking), followed by total elution

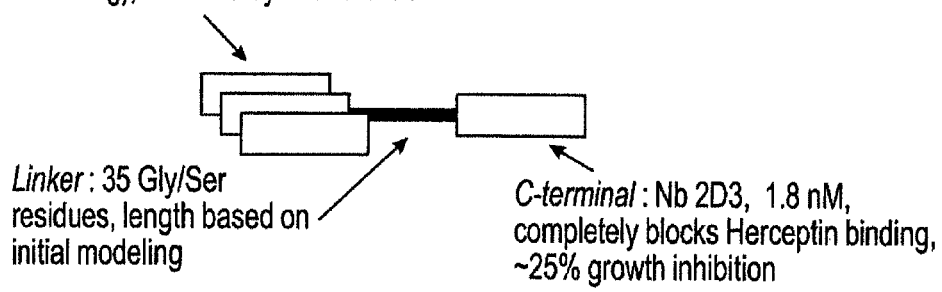

*Linker* : 35 Gly/Ser residues, length based on initial modeling

*C-terminal* : Nb 2D3, 1.8 nM, completely blocks Herceptin binding, ~25% growth inhibition ▼ Library of bispecific HER2-binding Nbs with 7 x 10$^7$ clones, 87% insert; diversity: 16 families in 72 sequences ▼ Expression induced and Nanobody IMAC purified from periplasm on PhyTip200$^+$ ▼ Tested in SKBR3 cell proliferation assay Biparatopic Nanobodies : Increasing the potency
of a Herceptin-competing Nanobody (3)

▼ Biparatopic Nanobodies in HTS identified showing either:
(1) No effect on cell proliferation
(2) Agonistic effect on cell proliferation (20-40% max)
(3) Stronger growth inhibitory effect compared to 2D3 and some compare to Herceptin Biparatopic Nanobodies : blocking two signaling pathways (1)

▼ Example : HER2, combining the mechanisms of actions of Herceptin and Omnitarg

▼ Concept validated by mixture of 2 mAbs : Friess et al., ESMO 2006 (animal models), Baselga et al., ASCO 2007 (Phase II combination trial)

Figure 27H

Biparatopic Nanobodies : blocking two signaling pathways (2)

- ▼ Approach : combine the mechanisms of actions of Herceptin and Omnitarg, by genetically fusing Nanobodies that compete with the respective binding regions and have a suitable linker/format that allows *intramolecular recognition*
- ▼ Building blocks :
  - Omnitarg-competing Nanobody : 47D5
  - Herceptin-competing Nanobodies : 2D3 and 5F7
  - Affinity for HER2 of 2D3, 5F7 and 47D5 not affected if placed C-terminally
- ▼ Linker : 35 Gly/Ser residues
- ▼ Biparatopics :
  - Fusion made with N and C-terminal moieties exchanged
  - Activity measured in MCF7-cells, measuring Heregulin-mediated activation of Erk1/2 and Akt signaling

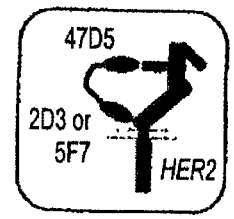

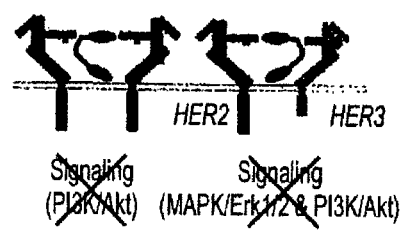

Biparatopic Nanobodies : blocking two signaling pathways (3)

▼ Biparatope formats combining Herceptin and Omnitarg competitive Nanobodies block Heregulin-mediated activation of MAPK/Erk1/2 *and* PI3/Akt signaling to greater extent than Herceptin or OT-Fab ▼ Format of building blocks impacts on potency Models of 5F7 and 47D5 in complex with HER-2 explain formatting effect Very likely to bind intramolecularly; no energetic barrier with long linker Unlikely to bind intramolecularly; high energy threshold to connect linker

Figure 27K

Nanobodies against HER-2, summary

Multivalent Nanobodies against HER-2:

▼ Useful for increasing avidity, potency, function, size (and PK)

▼ Potential for reduced immune complex formation yet very high affinity blockade

Biparatopic Nanobodies against HER-2:

▼ Useful for increasing avidity, potency, selectivity (for related antigens sharing epitopes)

▼ Useful for blocking multiple interaction sites on the same protein/receptor

▼ Potential for avoidance of agonist affects with avid binding moieties

▼ Avoidance of negative effect on immune complexes on clearance, toxicity?

AMINO ACID SEQUENCES DIRECTED AGAINST HER2 AND POLYPEPTIDES COMPRISING THE SAME FOR THE TREATMENT OF CANCERS AND/OR TUMORS

RELATED APPLICATIONS

This application is a national stage filing under 35 U.S.C. §371 of international application PCT/EP2008/066363, filed Nov. 27, 2008, which was published under PCT Article 21(2) in English, and claims the benefit under 35 U.S.C. §119(e) of U.S. provisional application Ser. No. 60/004,332, filed Nov. 27, 2007, U.S. provisional application Ser. No. 60/005,265, filed Dec. 4, 2007, U.S. provisional application Ser. No. 60/005,324, filed Dec. 4, 2007, and U.S. provisional application Ser. No. 60/005,331, filed Dec. 4, 2007, the disclosures of which are incorporated by reference herein in their entireties.

The present invention relates to amino acid sequences that are directed against (as defined herein) Epidermal Growth Factor Receptor 2 (HER2), as well as to compounds or constructs, and in particular proteins and polypeptides, that comprise or essentially consist of one or more such amino acid sequences (also referred to herein as "amino acid sequences of the invention", "compounds of the invention", and "polypeptides of the invention", respectively).

The invention also relates to nucleic acids encoding such amino acid sequences and polypeptides (also referred to herein as "nucleic acids of the invention" or "nucleotide sequences of the invention"); to methods for preparing such amino acid sequences and polypeptides; to host cells expressing or capable of expressing such amino acid sequences or polypeptides; to compositions, and in particular to pharmaceutical compositions, that comprise such amino acid sequences, polypeptides, nucleic acids and/or host cells; and to uses of such amino acid sequences or polypeptides, nucleic acids, host cells and/or compositions, in particular for prophylactic, therapeutic or diagnostic purposes, such as the prophylactic, therapeutic or diagnostic purposes mentioned herein.

Other aspects, embodiments, advantages and applications of the invention will become clear from the further description herein.

HER2 (also known as HER-2, Her-2, ErbB-2, ERBB2, EGF receptor 2, HER2/neu) is a member of the ErbB protein family, also known as the ERBB or the epidermal growth factor receptor family. This subclass I of the receptor tyrosine kinase (RTK) superfamily comprises four members: EGFR/ERBB1, HER2/ERBB2, HER3/ERBB3 and HER4/ERBB4. All members have an extracellular ligand-binding region, a single membrane-spanning region and a cytoplasmic tyrosine-kinase-containing domain. The ERBB receptors are expressed in various tissues of epithelial, mesenchymal and neuronal origin. Under normal physiological conditions, activation of the ERBB receptors is controlled by the spatial and temporal expression of their ligands, which are members of the EGF family of growth factors (Riese and Stern, 1998, Bioessays 20: 41; Yarden and Sliwkowski, 2001, Nature Rev. Mol. Cell. Biol. 2: 127). Ligand binding to ERBB receptors induces the formation of receptor homo- and heterodimers and activation of the intrinsic kinase domain, resulting in phosphorylation on specific tyrosine residues within the cytoplasmic tail. These phosphorylated residues serve as docking sites for a range of proteins, the recruitment of which leads to the activation of intracellular signalling pathways (Yarden and Sliwkowski, 2001, Nature Rev. Mol. Cell. Biol. 2: 127; Olayioye et al. 2000, EMBO J. 19: 3159; Schlessinger, 2004, Science 306: 1506; Hynes and Lane, 2005, Nature Reviews/Cancer 5: 341).

For the amino acid sequence of HER-2, reference is made to the sequences mentioned under Genbank accession numbers NM 001005862 en NM 004448 (both incorporated herein by reference). For the domain(s) of HER-2 involved in the interaction between HER-2 and Omnitarg and the amino acid sequence(s) thereof, reference is made to Franklin et al. (2004, Cancer cell 5:317-328; also incorporated herein by reference). For the domains of HER-2 involved in the interaction between HER-2 and Herceptin® and the amino acid sequence(s) thereof, reference is made to Cho et al. (2003, Nature 421:756-760; also incorporated herein by reference).

HER2 is thought to be an orphan receptor, with none of the EGF family of ligands able to activate it. However, ErbB receptors dimerise on ligand binding, and HER2 is the preferential dimerisation partner of other members of the ErbB family (Graus-Porta et al, 1997, EMBO J. 16: 1647).

The extracellular region of each ERBB receptor consists of four domains (I-IV). The structure of HER2's extracellular region is radically different from the other EGF receptors. In the other EGF receptors, in non-activated state, domain II binds to domain IV. Upon binding to domains I and III, the activating growth factor (ligand) selects and stabilizes a conformation that allows a dimerization arm to extend from domain II to interact with an ERBB dimer partner. HER2, on the other hand, has a fixed conformation that resembles the ligand-activated state: the domain II-IV interaction is absent and the dimerization loop in domain II is continuously exposed (in detail discussed in Hynes and Lane, 2005, Nature Reviews/Cancer 5: 341, Garrett et al. 2003, Mol. Cell. 11: 495; Cho et al. 2003, Nature 421: 756). This also explains why HER2 is the preferred dimerization partner.

Amplification of HER-2 leading to overexpression of the receptor, originally detected in a subset of breast tumours, occurs in various human cancers including ovarian, stomach, bladder, gastric and salivary cancers (Holbro and Hynes, 2004, Annu. Rev. Pharmacol. Toxicol. 44:195; Hynes and Stern, 1994, Biochim. Biophys. Acta 1198: 165). Approximately 25-30 percent of breast cancers have an amplification of the HER2/neu gene or overexpression of its protein product. Overexpression of this receptor in breast cancer is associated with increased disease recurrence and worse prognosis. Therefore, ERBB receptors have been intensely pursued as therapeutic targets (Holbro and Hynes, 2004, Annu. Rev. Pharmacol. Toxicol. 44:195).

mAb4D5, isolated by Ullrich et al. (Mol. Cell. Biol. 1989, 9: 1165), and trastuzumab (marketed as Herceptin®), its humanized (human IgG1 backbone, murine complementary-determining regions) variant (Carter et al. 1992, Proc. Natl. Acad. Sci. USA 89: 4285), block proliferation of HER2-overexpressing breast cancer cells. The structure of the trastuzumab Fab fragment bound to the extracellular portion of HER2 indicates that its epitope is toward the carboxyterminus of domain IV (Cho et al. 2003, Nature 421: 756). Domain IV does not participate in receptor dimerization, and blockade of dimerization does not explain the mechanism of action of this antibody. The mechanisms underlying trastuzumab's clinical efficacy is still under debate and seems to be multifaceted. Its inherent ability to recruit immune effector cells such as macrophages and monocytes to the tumor through the binding of its constant Fc domain to specific receptors on these cells, might be relevant for its anti-tumor activity. In addition to this Fc-mediated functions, preclinical studies have shown that the antibody downregulates HER2 levels (Hudziak et al. 1989, Mol. Cell. Biol 9: 1165) and HER2-mediated signaling pathways (Lane et al. 2000, Mol. Cell. Biol. 20: 3210, Motoyama et al. 2002, Cancer Res. 62: 3151). Furthermore, metalloproteinase-mediated. HER2 ectodomain shedding has been proposed to cause constitutive HER2 signaling and trastuzumab also blocks this process (Molina et al. 2001, Cancer Res. 61: 4744). Trastuzumab is only effective in breast cancer where the HER2/neu receptor is overexpressed. Clinical trials showed that the addition of trastuzumab to standard chemotherapy prolonged relapse-free survival, leading to the approval of the drug for treatment of HER2-overexpressing metastatic breast cancer patients.

Another monoclonal antibody, pertuzumab (Omnitarg) (Olayioye, 2001, Breast Cancer Res 3: 385), which inhibits ligand activation of an ErbB hetero-oligomer comprising HER2 and HER3, HER4 or EGFR, is in advanced clinical trials. Pertuzumab binds to HER2 near the center of domain II. Binding is predicted to sterically block the region necessary for HER2 dimerization with other ERBBs (Franklin et al. 2004, Cancer Cell 5: 317), Pertuzumab but not trastuzumab inhibits the growth of tumors displaying low HER2 levels (Agus et al. 2002, Cancer Cell 2: 127).

A specific, but non-limiting object of the invention is to provide therapeutic compounds that have improved therapeutic and/or pharmacological properties and/or other advantageous properties (such as, for example, improved ease of preparation and/or reduced costs of goods), compared to these conventional antibodies. These improved and advantageous properties will become clear from the further description herein. The therapeutic compounds provided by the invention may, for example, have an increased avidity and/or potency, an increased selectivity and/or they may be capable of partially or totally blocking certain (one or more) sites.

The polypeptides and compositions of the present invention can generally be used to bind HER2 and, by this binding to HER2, modulate, and in particular inhibit or prevent, the signalling that is mediated by HER2, to modulate the biological pathways in which HER2 is involved, and/or to modulate the biological mechanisms, responses and effects associated with such signalling or these pathways (which are also referred to herein as "modes of action" of the polypeptides and compositions of the invention).

One specific, non-limiting, object of the invention is to provide therapeutic compounds that combine two or more modes of action, e.g. by blocking of two or more different cell signalling pathways. One specific, but non-limiting object of the invention is to provide therapeutic compounds that combine the mode of action of Herceptin® and Omnitarg.

The polypeptides and compositions of the present invention can be used to modulate, and in particular inhibit and/or prevent, dimerization of HER2 with an ERBB receptor, and thus to modulate, and in particular inhibit or prevent, the signalling that is mediated by dimerization of HER2 with said ERBB receptor, to modulate the biological pathways in which HER2 and/or said ERBB receptor are involved, and/or to modulate the biological mechanisms, responses and effects associated with such signalling or these pathways.

As such, the polypeptides and compositions of the present invention can be used for the prevention and treatment (as defined herein) of cancers and/or tumors. Generally, "cancers and/or tumors" can be defined as diseases and disorders that can be prevented and/or treated, respectively, by suitably administering to a subject in need thereof (i.e. having the disease or disorder or at least one symptom thereof and/or at risk of attracting or developing the disease or disorder) of either a polypeptide or composition of the invention (and in particular, of a pharmaceutically active amount thereof) and/or of a known active principle active against HER2 or a biological pathway or mechanism in which HER2 is involved (and in particular, of a pharmaceutically active amount thereof). Examples of such cancers and/or tumors will be clear to the skilled person based on the disclosure herein, and for example include the following diseases and disorders: breast cancer and/or tumors, ovarian cancer and/or tumors, stomach cancer and/or tumors, bladder cancer and/or tumors, gastric cancer and/or tumors, salivary cancer and/or tumors, and prostate cancer.

In particular, the polypeptides and compositions of the present invention can be used for the prevention and treatment of cancers and/or tumors which are characterized by excessive and/or unwanted signalling mediated by HER2 or by the pathway(s) in which HER2 is involved. Examples of such cancers and/or tumors will again be clear to the skilled person based on the disclosure herein.

Thus, without being limited thereto, the amino acid sequences and polypeptides of the invention can for example be used to prevent and/or to treat all diseases and disorders that are currently being prevented or treated with active principles that can modulate HER2-mediated signalling, such as those mentioned in the prior art cited above. It is also envisaged that the polypeptides of the invention can be used to prevent and/or to treat all diseases and disorders for which treatment with such active principles is currently being developed, has been proposed, or will be proposed or developed in future. In addition, it is envisaged that, because of their favourable properties as further described herein, the polypeptides of the present invention may be used for the prevention and treatment of other diseases and disorders than those for which these known active principles are being used or will be proposed or developed; and/or that the polypeptides of the present invention may provide new methods and regimens for treating the diseases and disorders described herein.

Other applications and uses of the amino acid sequences and polypeptides of the invention will become clear to the skilled person from the further disclosure herein.

Generally, it is an object of the invention to provide pharmacologically active agents, as well as compositions comprising the same, that can be used in the diagnosis, prevention and/or treatment of cancers and/or tumors and of the further diseases and disorders mentioned herein; and to provide methods for the diagnosis, prevention and/or treatment of such diseases and disorders that involve the administration and/or use of such agents and compositions.

In particular, it is an object of the invention to provide such pharmacologically active agents, compositions and/or methods that have certain advantages compared to the agents, compositions and/or methods that are currently used and/or known in the art. These advantages will become clear from the further description below.

More in particular, it is an object of the invention to provide therapeutic proteins that can be used as pharmacologically active agents, as well as compositions comprising the same, for the diagnosis, prevention and/or treatment of cancers and/or tumors and of the further diseases and disorders mentioned herein; and to provide methods for the diagnosis, prevention and/or treatment of such diseases and disorders that involve the administration and/or the use of such therapeutic proteins and compositions.

Accordingly, it is a specific object of the present invention to provide amino acid sequences that are directed against (as defined herein) HER2, in particular against HER2 from a warm-blooded animal, more in particular against HER2 from a mammal, and especially against human HER2 (and specifically, against human HER-2 with the amino acid sequence given under Genbank accession numbers NM 001005862 en NM 004448); and to provide proteins and polypeptides comprising or essentially consisting of at least one such amino acid sequence.

In particular, it is a specific object of the present invention to provide such amino acid sequences and such proteins and/or polypeptides that are suitable for prophylactic, therapeutic and/or diagnostic use in a warm-blooded animal, and in particular in a mammal, and more in particular in a human being.

More in particular, it is a specific object of the present invention to provide such amino acid sequences and such proteins and/or polypeptides that can be used for the prevention, treatment, alleviation and/or diagnosis of one or more diseases, disorders or conditions associated with HER2 and/or mediated by HER2 (such as the diseases, disorders and conditions mentioned herein) in a warm-blooded animal, in particular in a mammal, and more in particular in a human being.

It is also a specific object of the invention to provide such amino acid sequences and such proteins and/or polypeptides that can be used in the preparation of pharmaceutical or veterinary compositions for the prevention and/or treatment of one or more diseases, disorders or conditions associated with and/or mediated by HER2 (such as the diseases, disorders and conditions mentioned herein) in a warm-blooded animal, in particular in a mammal, and more in particular in a human being.

In the invention, generally, these objects are achieved by the use of the amino acid sequences, proteins, polypeptides and compositions that are described herein.

In general, the invention provides amino acid sequences that are directed against (as defined herein) and/or can specifically bind (as defined herein) to HER2; as well as compounds and constructs, and in particular proteins and polypeptides, that comprise at least one such amino acid sequence.

More in particular, the invention provides amino acid sequences that can bind to HER2 with an affinity (suitably measured and/or expressed as a $K_D$-value (actual or apparent), a $K_A$-value (actual or apparent), a $k_{on}$-rate and/or a $k_{off}$-rate, or alternatively as an $IC_{50}$ value, as further described herein) that is as defined herein; as well as compounds and constructs, and in particular proteins and polypeptides, that comprise at least one such amino acid sequence.

In particular, amino acid sequences and polypeptides of the invention are preferably such that they:
  bind to HER2 with a dissociation constant ($K_D$) of $10^{-5}$ to $10^{-12}$ moles/liter or less, and preferably $10^{-7}$ to $10^{-12}$ moles/liter or less and more preferably $10^{-8}$ to $10^{-12}$ moles/liter (i.e. with an association constant ($K_A$) of $10^5$ to $10^{12}$ liter/moles or more, and preferably $10^7$ to $10^{12}$ liter/moles or more and more preferably $10^8$ to $10^{12}$ liter/moles);
and/or such that they:
  bind to HER2 with a $k_{on}$-rate of between $10^2$ M$^{-1}$ s$^{-1}$ to about $10^7$ M$^{-1}$ s$^{-1}$, preferably between $10^3$ M$^{-1}$ s$^{-1}$ and $10^7$ M$^{-1}$ s$^{-1}$, more preferably between $10^4$ M$^{-1}$ s$^{-1}$ and $10^7$ M$^{-1}$ s$^{-1}$, such as between $10^5$ M$^{-1}$ s$^{-1}$ and $10^7$ M$^{-1}$ s$^{-1}$;
and/or such that they:
  bind to HER2 with a $k_{off}$ rate between 1 s$^{-1}$ ($t_{1/2}$=0.69 s) and $10^{-6}$ s$^{-1}$ (providing a near irreversible complex with a $t_{1/2}$ of multiple days), preferably between $10^{-2}$ s$^{-1}$ and $10^{-6}$ s$^{-1}$, more preferably between $10^{-3}$ s$^{-1}$ and $10^{-6}$ s$^{-1}$, such as between $10^{-4}$ s$^{-1}$ and $10^{-6}$ s$^{-1}$.

Preferably, a monovalent amino acid sequence of the invention (or a polypeptide that contains only one amino acid sequence of the invention) is preferably such that it will bind to HER2 with an affinity less than 500 nM, preferably less than 200 nM, more preferably less than 10 nM, such as less than 500 pM.

Some preferred $IC_{50}$ values for binding of the amino acid sequences or polypeptides of the invention to HER2 will become clear from the further description and examples herein.

For binding to HER2, an amino acid sequence of the invention will usually contain within its amino acid sequence one or more amino acid residues or one or more stretches of amino acid residues (i.e. with each "stretch" comprising two or more amino acid residues that are adjacent to each other or in close proximity to each other, i.e. in the primary or tertiary structure of the amino acid sequence) via which the amino acid sequence of the invention can bind to HER2, which amino acid residues or stretches of amino acid residues thus form the "site" for binding to HER2 (also referred to herein as the "antigen binding site").

The amino acid sequences provided by the invention are preferably in essentially isolated form (as defined herein), or form part of a protein or polypeptide of the invention (as defined herein), which may comprise or essentially consist of one or more amino acid sequences of the invention and which may optionally further comprise one or more further amino acid sequences (all optionally linked via one or more suitable linkers). For example, and without limitation, the one or more amino acid sequences of the invention may be used as a binding unit in such a protein or polypeptide, which may optionally contain one or more further amino acid sequences that can serve as a binding unit (i.e. against one or more other targets than HER2), so as to provide a monovalent, multivalent or multispecific polypeptide of the invention, respectively, all as described herein. Such a protein or polypeptide may also be in essentially isolated form (as defined herein).

The amino acid sequences and polypeptides of the invention as such preferably essentially consist of a single amino acid chain that is not linked via disulphide bridges to any other amino acid sequence or chain (but that may or may not contain one or more intramolecular disulphide bridges. For example, it is known that Nanobodies—as described herein—may sometimes contain a disulphide bridge between CDR3 and CDR1 or FR2). However, it should be noted that one or more amino acid sequences of the invention may be linked to each other and/or to other amino acid sequences (e.g. via disulphide bridges) to provide peptide constructs that may also be useful in the invention (for example Fab' fragments, F(ab')$_2$ fragments, ScFv constructs, "diabodies" and other multispecific constructs. Reference is for example made to the review by Holliger and Hudson, Nat Biotechnol. 2005 September; 23(9):1126-36).

Generally, when an amino acid sequence of the invention (or a compound, construct or polypeptide comprising the same) is intended for administration to a subject (for example for therapeutic and/or diagnostic purposes as described herein), it is preferably either an amino acid sequence that does not occur naturally in said subject; or, when it does occur naturally in said subject, in essentially isolated form (as defined herein).

It will also be clear to the skilled person that for pharmaceutical use, the amino acid sequences of the invention (as well as compounds, constructs and polypeptides comprising the same) are preferably directed against human HER2; whereas for veterinary purposes, the amino acid sequences and polypeptides of the invention are preferably directed against HER2 from the species to be treated, or at least cross-reactive with HER2 from the species to be treated.

Furthermore, an amino acid sequence of the invention may optionally, and in addition to the at least one binding site for binding against HER2, contain one or more further binding sites for binding against other antigens, proteins or targets. The efficacy of the amino acid sequences and polypeptides of the invention, and of compositions comprising the same, can be tested using any suitable in vitro assay, cell-based assay, in vivo assay and/or animal model known per se, or any combination thereof, depending on the specific disease or disorder involved. Suitable assays and animal models will be clear to the skilled person, and for example include BIAcore binding assay, FACS binding and/or competition assay, ELISA binding and/or competition assay, FMAT binding and/or competition assay, Alphascreen binding and/or competition assay, tumor (e.g. SKBR3) cell proliferation assay (Hudziak et al., Molecular and Cellular Biology 9:1165-1172, 1989), cell signalling assays (Agus et al., Cancer Cell 2:127-136, 2002), SCID mice with implanted tumor (i.e. Xenograft mice) (Agus et al., Cancer Cell 2:127-136, 2002), HER2-transgenic mice (Scwall et al., Breast Cancer Res 5(Suppl 1):14, 2003), as well as the assays and animal models used in the experimental part below and in the prior art cited herein.

Also, according to the invention, amino acid sequences and polypeptides that are directed against HER2 from a first species of warm-blooded animal may or may not show cross-reactivity with HER2 from one or more other species of warm-blooded animal. For example, amino acid sequences and polypeptides directed against human HER2 may or may not show cross reactivity with HER2 from one or more other species of primates (such as, without limitation, monkeys from the genus *Macaca* (such as, and in particular, cynomologus monkeys (*Macaca fascicularis*) and/or rhesus monkeys (*Macaca mulatta*)) and baboon (*Papio ursinus*)) and/or with HER2 from one or more species of animals that are often used in animal models for diseases (for example mouse, rat, rabbit, pig or dog), and in particular in animal models for diseases and disorders associated with HER2 (such as the species and animal models mentioned herein). In this respect, it will be clear to the skilled person that such cross-reactivity, when present, may have advantages from a drug development point of view, since it allows the amino acid sequences and polypeptides against human. HER2 to be tested in such disease models.

More generally, amino acid sequences and polypeptides of the invention that are cross-reactive with HER2 from multiple species of mammal will usually be advantageous for use in veterinary applications, since it will allow the same amino acid sequence or polypeptide to be used across multiple species. Thus, it is also encompassed within the scope of the invention that amino acid sequences and polypeptides directed against HER2 from one species of animal (such as amino acid sequences and polypeptides against human HER2) can be used in the treatment of another species of animal, as long as the use of the amino acid sequences and/or polypeptides provide the desired effects in the species to be treated.

The present invention is in its broadest sense also not particularly limited to or defined by a specific antigenic determinant, epitope, part, domain (I, II, III and/or IV), subunit or conformation (where applicable) of HER2 against which the amino acid sequences and polypeptides of the invention are directed. For example, the amino acid sequences and polypeptides may or may not be directed against an "interaction site" (as defined herein). However, it is generally assumed and preferred that the amino acid sequences and polypeptides of the invention are preferably at least directed against an interaction site (as defined herein), and in particular against the Herceptin® binding site on HER2 (see Cho et al, (2003), Nature 421:756-760), the Omnitarg binding site on HER2 (see Franklin et al. (2004), Cancer cell 5:317-328), or the Herceptin® binding site and the Omnitarg binding site on HER2.

An amino acid of the invention that is directed against and/or binds one specific antigenic determinant, or epitope of a target or antigen (such as a specific antigenic determinant, epitope, part, domain (I, II, III and/or IV) or subunit of HER2) while not binding any other antigenic determinant, or epitope of the target or antigen and not binding any other target or antigen, is also referred to herein as monovalent amino acid or monovalent construct of the invention.

As further described herein, a polypeptide of the invention may contain two or more (monovalent) amino acid sequences or monovalent constructs of the invention that are directed against HER2. Generally, such polypeptides will bind to HER2 with increased avidity compared to a single amino acid sequence of the invention. Such a polypeptide may for example comprise two amino acid sequences of the invention that are directed against the same antigenic determinant, epitope, part, domain, subunit or confirmation (where applicable) of HER2 (which may or may not be an interaction site); or comprise at least one "first" amino acid sequence of the invention that is directed against a first same antigenic determinant, epitope, part, domain, subunit or confirmation (where applicable) of HER2 (which may or may not be an interaction site); and at least one "second" amino acid sequence of the invention that is directed against a second antigenic determinant, epitope, part, domain, subunit or confirmation (where applicable) different from the first (and which again may or may not be an interaction site). Preferably, in such "biparatopic" polypeptides of the invention, at least one amino acid sequence of the invention is directed against an interaction site (as defined herein), although the invention in its broadest sense is not limited thereto.

Also, when the target is part of a binding pair (for example, a receptor-ligand binding pair), the amino acid sequences and polypeptides may be such that they compete with the cognate binding partner (e.g. the ligand, receptor or other binding partner, as applicable) for binding to the target, and/or such that they (fully or partially) neutralize binding of the binding partner to the target.

Thus, in one preferred, but non-limiting aspect, the amino acid sequences and polypeptides of the invention are directed against the Herceptin® binding site on HER2 and/or are capable of competing with Herceptin® for binding to HER-2, as determined using a suitable competition assay, such as the assay described in. Example 8. Such amino acid sequences and polypeptides of the invention may be as further defined herein. The amino acid sequences and polypeptides of the invention may in particular be directed against domain IV of HER2. In a preferred aspect, the amino acid sequences and polypeptides of the invention are directed against the C-terminus of domain IV of HER2.

In another preferred, but non-limiting aspect, the amino acid sequences and polypeptides of the invention are capable, upon binding to HER-2, to (i) recruit immune effector cells such as macrophages and monocytes to the tumor (for this purpose, most preferably a polypeptide of the invention is used that contains an Fc portion that confers upon the polypeptide the ability to recruit immune effector cells such as macrophages and monocytes to the tumor); and/or (ii) modulate (as defined herein) HER-2 or HER-2 mediated signalling by downregulating HER2 levels (for example, as determined by the methodology described in Hudziak et al. 1989, Mol. Cell. Biol 9: 1165) and/or by downregulating HER2-mediated signaling pathways (for example, as determined by the methodology described in Lane et al. 2000, Mol. Cell. Biol. 20: 3210, Motoyama et al. 2002, Cancer Res. 62: 3151); and/or (iii) modulate (as defined herein) HER-2 or HER-2 mediated signalling by blocking or inhibiting metalloproteinase-mediated HER2 ectodomain shedding (for example, as determined by the methodology described in Molina et al. 2001, Cancer Res. 61: 4744); or more generally capable of modulating (as defined herein) HER-2 or HER-2 mediated signalling via the same mechanism of action as Herceptin®. Such amino acid sequences and polypeptides of the invention preferably are directed against the Herceptin® binding site on HER2 and/or capable of competing with Herceptin® for binding to HER-2, and may in particular be directed against domain IV of HER2, and more in particular against the C-terminus of domain IV of HER2 (see also Cho et al. (2003), Nature 421:756-760).

In another preferred, but non-limiting aspect, the amino acid sequences and polypeptides of the invention are directed against the Omnitarg binding site on HER2 and/or are capable of competing with Omnitarg (and/or with the Omnitarg-Fab used in Example 9) for binding to HER-2, as determined using a suitable competition assay, such as the assay described in Example 9. Such amino acid sequences and polypeptides of the invention may be as further defined herein. The amino acid sequences and polypeptides of the invention may be directed against domain II of HER2. In a preferred aspect, the amino acid sequences and polypeptides of the invention are directed against the center of domain II of HER2.

In another preferred, but non-limiting aspect, the amino acid sequences and polypeptides of the invention are capable, upon binding to HER-2, to modulate (as defined herein) HER-2 or HER-2 mediated signalling by inhibiting ligand activation of an ErbB hetero-oligomer comprising HER2 and HER3, HERO or EGFR, or more generally capable of modulating (as defined herein) HER-2 or HER-2 mediated signalling via the same mechanism of action as Omnitarg. Such amino acid sequences and polypeptides of the invention preferably are directed against the Omnitarg binding site on HER2 and/or capable of competing with Omnitarg (and/or with the Omnitarg-Fab used in Example 9) for binding to HER-2, and may in particular be directed against domain II of HER2, and more in particular against the middle of domain II of HER2 (see also Franklin et al. (2004), Cancer cell 5:317-328).

It is also within the scope of the invention that, where applicable, an amino acid sequence or polypeptide of the invention can bind to two or more antigenic determinants, epitopes, parts, domains, subunits or confirmations of HER2. In such a case, the antigenic determinants, epitopes, parts, domains or subunits of HER2 to which the amino acid sequences and/or polypeptides of the invention bind may be essentially the same (for example, if HER2 contains repeated structural motifs or occurs in a multimeric form) or may be different (and in the latter case, the amino acid sequences and polypeptides of the invention may bind to such different antigenic determinants, epitopes, parts, domains, subunits of HER2 with an affinity and/or specificity which may be the same or different).

In a preferred aspect, the amino acid sequences and (in particular) polypeptides of the invention are capable of binding to two or more different antigenic determinants, epitopes, parts, domains of HER2. In this context, the amino acid sequences and polypeptides of the invention are also referred to as "multiparatopic" (such as e.g. "biparatopic" or "triparatopic", etc.) amino acid sequences and polypeptides. The multiparatopic amino acid sequences and polypeptides of the invention can be directed against any antigenic determinants, epitopes, parts, and/or domains of HER2.

For example, and generally, a biparatopic polypeptide of the invention may comprise at least one amino acid sequence of the invention directed against a first antigenic determinant, epitope, part or domain of HER-2 and at least one amino acid sequence of the invention directed against a second antigenic determinant, epitope, part or domain of HER-2 different from the first antigenic determinant, epitope, part or domain (in which said amino acid sequences may be suitably linked, for example via a suitable linker as further described herein). Preferably, such a biparatopic polypeptide of the invention is further such that, when it binds to HER-2, it is capable of simultaneously binding to the first antigenic determinant, epitope, part or domain (i.e. via the at least one amino acid sequence of the invention capable of binding to said first antigenic determinant, epitope, part or domain) and binding to said second antigenic determinant, epitope, part or domain (i.e. via the at least one amino acid sequence of the invention capable of binding to said second antigenic determinant, epitope, part or domain). Examples of such biparatopic polypeptides of the invention will become clear from the further description herein. Also; a triparatopic polypeptide of the invention may comprise at least one further amino acid sequence of the invention directed against a third antigenic determinant, epitope, part or domain of HER-2 (different from both the first and second antigenic determinant, epitope, part or domain), and generally multiparatopic polypeptides of the invention may contain at least two amino acid sequences of the invention directed against at least two different antigenic determinants, epitopes, parts or domains of HER-2. Generally, such biparatopic, triparatopic and multiparatopic polypeptides of the invention may be as further described herein, and the various preferred aspects of the invention as described herein also apply to these biparatopic, triparatopic and multiparatopic polypeptides of the invention (for example, these biparatopic, triparatopic and multiparatopic polypeptides of the invention preferably comprise single variable domains and more preferably Nanobodies).

In a preferred, but non-limiting aspect, the amino acid sequences and (in particular) polypeptides of the invention are biparatopic (or multiparatopic) and are directed against the Herceptin® binding site on HER2 and/or capable of competing with Herceptin® for binding to HER-2, as well as against at least one other antigenic determinant, epitope, part or domain on HER2. The amino acid sequences and polypeptides of the invention may be directed against domain IV of HER2 as well as against at least one other antigenic determinant, epitope, part or domain on HER2. In a preferred aspect, the amino acid sequences and polypeptides of the invention are directed against the C-terminus of domain IV of HER2 as well as against at least one other antigenic determinant, epitope, part or domain on. HER2. Generally, such a biparatopic (or multiparatopic) polypeptide of the invention will contain at least one amino acid sequence of the invention that is capable of binding to the Herceptin® binding site on HER2 and/or capable of competing with Herceptin® for binding to HER-2 (and in particular against the domain IV of HER-2 and more preferably against the C-terminus of domain IV of HER2), as well as at least one further amino acid sequence of the invention that is capable of binding to at least one other antigenic determinant, epitope, part or domain on HER2. Generally, such biparatopic (or multiparatopic) polypeptides of the invention may be as further described herein, and the various preferred aspects of the invention as described herein also apply to these biparatopic (or multiparatopic) polypeptides of the invention (for example, these biparatopic and multiparatopic polypeptides of the invention may comprise suitable linkers; are preferably such that they can simultaneously bind the Herceptin® binding site and the at least one other antigenic determinant, epitope, part or domain on HER2; and preferably comprise single variable domains and more preferably Nanobodies).

In another preferred, but non-limiting aspect, the amino acid sequences and (in particular) polypeptides of the invention are biparatopic (or multiparatopic) and are at least capable, upon binding to HER-2, to (i) recruit immune effector cells such as macrophages and monocytes to the tumor (for this purpose, most preferably a polypeptide of the invention is used that contains an Fc portion that confers upon the polypeptide the ability to recruit immune effector cells such as macrophages and monocytes to the tumor); and/or (ii) modulate (as defined herein) HER-2 or HER-2 mediated signalling by downregulating HER2 levels (for example, as determined by the methodology described in Hudziak et al. 1989, Mol. Cell. Biol 9: 1165) and/or by downregulating HER2-mediated signaling pathways (for example, as determined by the methodology described in Lane et al. 2000, Mol. Cell. Biol. 20: 3210, Motoyama et al. 2002, Cancer Res. 62: 3151); and/or (iii) modulate (as defined herein) HER-2 or HER-2 mediated signalling by blocking or inhibiting metalloproteinase-mediated HER2 ectodomain shedding (for example, as determined by the methodology described in Molina et al. 2001, Cancer Res. 61: 4744); or more generally by modulating (as defined herein) HER-2 or HER-2 mediated signalling via the same mechanism of action as Herceptin®.

Such biparatopic (or multiparatopic) polypeptides of the invention preferably either (a) comprise an Fc portion that confers upon the polypeptide the ability to recruit immune effector cells such as macrophages and monocytes to the tumor), and/or (b) comprise at least one amino acid sequence of the invention that is capable, upon binding to HER-2, to (1) modulate (as defined herein) HER-2 or HER-2 mediated signalling by downregulating HER2 levels and/or by downregulating HER2-mediated signaling pathways; and/or (2) modulate (as defined herein) HER-2 or HER-2 mediated signalling by blocking or inhibiting metalloproteinase-mediated HER2 ectodomain shedding; or more generally (3) modulate (as defined herein) HER-2 or HER-2 mediated signalling via the same mechanism of action as Herceptin®; as well as at least one further amino acid sequence of the invention that is capable of binding to at least one other antigenic determinant, epitope, part or domain on HER2 (i.e. different from the antigenic determinant, epitope, part or domain to which the aforementioned amino acid sequence of the invention can bind). Such biparatopic (or multiparatopic) polypeptides of the invention preferably comprise at least one amino acid sequence of the invention that is directed against the Herceptin® binding site on HER2 and/or capable of competing with Herceptin® for binding to HER-2 (and in particular against domain IV of HER2, and more in particular against the C-terminus of domain IV of HER2), as well as at least one further amino acid sequence of the invention that is capable of binding to at least one other antigenic determinant, epitope, part or domain on HER2. Generally, such biparatopic (or multiparatopic) polypeptides of the invention may be as further described herein, and the various preferred aspects of the invention as described herein also apply to these biparatopic (or multiparatopic) polypeptides of the invention (for example, these biparatopic and multiparatopic polypeptides of the invention may comprise suitable linkers; are preferably such that they can simultaneously bind the Herceptin® binding site and the at least one other antigenic determinant, epitope, part or domain on HER2; and preferably comprise single variable domains and more preferably Nanobodies).

In another preferred, but non-limiting aspect, the amino acid sequences and polypeptides of the invention are biparatopic (or multiparatopic) and are directed against the Omnitarg binding site on HER2 and/or capable of competing with Omnitarg for binding to HER-2, as well as against at least one other antigenic determinant on HER2. The amino acid sequences and polypeptides of the invention may be directed against domain II of HER2 as well as against at least one other antigenic determinant on HER2. In a preferred aspect, the amino acid sequences and polypeptides of the invention are directed against the center of domain II of HER2 as well as against at least one other antigenic determinant on HER2. Generally, such a biparatopic (or multiparatopic) polypeptide of the invention will contain at least one amino acid sequence of the invention that is capable of binding to the Omnitarg binding site on HER2 and/or capable of competing with Omnitarg for binding to HER-2 (and in particular against the domain II of HER-2 and more preferably against the middle of domain. II of HER2), as well as at least one further amino acid sequence of the invention that is capable of binding to at least one other antigenic determinant, epitope, part or domain on HER2. Generally, such biparatopic (or multiparatopic) polypeptides of the invention may be as further described herein, and the various preferred aspects of the invention as described herein also apply to these biparatopic (or multiparatopic) polypeptides of the invention (for example, these biparatopic and multiparatopic polypeptides of the invention may comprise suitable linkers; are preferably such that they can simultaneously bind the Omnitarg binding site and the at least one other antigenic determinant, epitope, part or domain on HER2; and preferably comprise single variable domains and more preferably Nanobodies).

In another preferred, but non-limiting aspect, the amino acid sequences and (in particular) polypeptides of the invention are biparatopic (or multiparatopic) and are at least capable, upon binding to HER-2, to modulate (as defined herein) HER-2 or HER-2 mediated signalling by inhibiting ligand activation of an ErbB hetero-oligomer comprising HER2 and HER3, HER4 or EGFR, or more generally capable of modulating (as defined herein) HER-2 or HER-2 mediated signalling via the same mechanism of action as Omnitarg.

Such biparatopic (or multiparatopic) polypeptides of the invention preferably comprise at least one amino acid sequence of the invention that is capable, upon binding to HER-2, to modulate (as defined herein) HER-2 or HER-2 mediated signalling by inhibiting ligand activation of an ErbB hetero-oligomer comprising HER2 and HER3, HER4 or EGFR, or more generally capable of modulating (as defined herein) HER-2 or HER-2 mediated signalling via the same mechanism of action as Omnitarg; as well as at least one further amino acid sequence of the invention that is capable of binding to at least one other antigenic determinant, epitope, part or domain on HER2 (i.e. different from the antigenic determinant, epitope, part or domain to which the aforementioned amino acid sequence of the invention can bind). Such biparatopic (or multiparatopic) polypeptides of the invention preferably comprise at least one amino acid sequence of the invention that is directed against the Omnitarg binding site on HER2 and/or capable of competing with Omnitarg for binding to HER-2 (and in particular against domain II of HER2, and more in particular against the middle of domain II of HER2), as well as at least one further amino acid sequence of the invention that is capable of binding to at least one other antigenic determinant, epitope, part or domain on HER2. Generally, such biparatopic (or multiparatopic) polypeptides of the invention may be as further described herein, and the various preferred aspects of the invention as described herein also apply to these biparatopic (or multiparatopic) polypeptides of the invention (for example, these biparatopic and multiparatopic polypeptides of the invention may comprise suitable linkers; are preferably such that they can simultaneously bind the Omnitarg binding site and the at least one other antigenic determinant, epitope, part or domain on HER2; and preferably comprise single variable domains and more preferably Nanobodies).

In another preferred, but non-limiting aspect, the amino acid sequences and (in particular) polypeptides of the invention are biparatopic and are at least directed against the Herceptin® binding site on HER2 as well as against the Omnitarg binding site on HER2. The amino acid sequences and polypeptides of the invention may be directed against domain IV of HER2. The amino acid sequences and polypeptides of the invention may be directed against domain II of HER2. The amino acid sequences and polypeptides of the invention may be directed against domain IV of HER2 as well as against domain II of HER2. In a preferred aspect, the amino acid sequences and polypeptides of the invention are directed against the C-terminus of domain IV of HER2. In another preferred aspect, the amino acid sequences and polypeptides of the invention are directed against the C-terminus of domain IV of HER2 as well as against domain H of HER2. In another preferred aspect, the amino acid sequences and polypeptides of the invention are directed against the center of domain II of HER2. In another preferred aspect, the amino acid sequences and polypeptides of the invention are directed against domain IV of HER2 as well as against the center of domain II of HER2. In another preferred aspect, the amino acid sequences and polypeptides of the invention are directed against the C-terminus of domain IV of HER2 as well as against the center of domain II of HER2.

Again, the above biparatopic (or multiparatopic) polypeptides of the invention may be as further described herein, and the various preferred aspects of the invention as described herein also apply to these biparatopic (or multiparatopic) polypeptides of the invention (for example, these biparatopic and multiparatopic polypeptides of the invention may comprise suitable linkers; are preferably such that they can simultaneously bind the Omnitarg binding site and the Herceptin®-binding site; and preferably comprise single variable domains and more preferably Nanobodies).

In another preferred, but non-limiting aspect, the amino acid sequences and (in particular) polypeptides of the invention are biparatopic with both paratopes directed against the Herceptin® binding site on HER2. The amino acid sequences and polypeptides of the invention may be directed against domain IV of HER2 (one paratope or both paratopes). In a preferred aspect, the amino acid sequences and polypeptides of the invention are directed against the C-terminus of domain IV of HER2 (one paratope or both paratopes).

In another preferred, but non-limiting aspect, the amino acid sequences and (in particular) polypeptides of the invention are biparatopic with both paratopes directed against the Omnitarg binding site on HER2. The amino acid sequences and polypeptides of the invention may be directed against domain. II of HER2 (one paratope or both paratopes). In a preferred aspect, the amino acid sequences and polypeptides of the invention are directed against the center of domain. II of HER2 (one paratope or both paratopes).

Again, the above biparatopic (or multiparatopic) polypeptides of the invention may be as further described herein, and the various preferred aspects of the invention as described herein also apply to these biparatopic (or multiparatopic) polypeptides of the invention (for example, these biparatopic and multiparatopic polypeptides of the invention may comprise suitable linkers; are preferably such that they can simultaneously bind both binding sites; and preferably comprise single variable domains and more preferably Nanobodies).

In another preferred, but non-limiting aspect, the amino acid sequences and (in particular) polypeptides of the invention are biparatopic (or multiparatopic) and are at least capable, upon binding to HER-2, (A) to modulate (as defined herein) HER-2 or HER-2 mediated signalling by inhibiting ligand activation of an ErbB hetero-oligomer comprising HER2 and HER3, HER4 or EGFR, or more generally capable of modulating (as defined herein) HER-2 or HER-2 mediated signalling via the same mechanism of action as Omnitarg; and (B) to (i) recruit immune effector cells such as macrophages and monocytes to the tumor (for this purpose, most preferably a polypeptide of the invention is used that contains an Fc portion that confers upon the polypeptide the ability to recruit immune effector cells such as macrophages and monocytes to the tumor); and/or (ii) modulate (as defined herein) HER-2 or HER-2 mediated signalling by downregulating HER2 levels and/or by down-regulating HER2-mediated signaling pathways; and/or (iii) modulate (as defined herein) HER-2 or HER-2 mediated signalling by blocking or inhibiting metalloproteinase-mediated HER2 ectodomain shedding; or more generally by modulating (as defined herein) HER-2 or HER-2 mediated signalling via the same mechanism of action as Herceptin®.

For example, for this purpose, such a biparatopic (or multiparatopic) polypeptide of the invention may comprise
- at least one first amino acid sequence of the invention that is capable, upon binding to HER-2, to modulate (as defined herein) HER-2 or HER-2 mediated signalling by inhibiting ligand activation of an ErbB hetero-oligomer comprising HER2 and HER3, HER4 or EGFR, or more generally capable of modulating (as defined herein) HER-2 or HER-2 mediated signalling via the same mechanism of action as Omnitarg. Such an amino acid sequence of the invention is preferably an amino acid sequence that is directed against the Omnitarg binding site on HER2 (and in particular against domain II of HER2, and more in particular against the middle of domain II of HER2) and/or capable of competing with Omnitarg for binding to HER-2;
- and further comprise either
- an Fc portion that confers upon the polypeptide the ability to recruit immune effector cells such as macrophages and monocytes to the tumor),
- and/or
- at least one amino acid sequence of the invention that is capable, upon binding to HER-2, to (1) modulate (as defined herein) HER-2 or HER-2 mediated signalling by downregulating HER2 levels and/or by downregulating HER2-mediated signaling pathways; and/or (2) modulate (as defined herein) HER-2 or HER-2 mediated signalling by blocking or inhibiting metalloproteinase-mediated HER2 ectodomain shedding; or more generally (3) modulate (as defined herein) HER-2 or HER-2 mediated signalling via the same mechanism of action as Herceptin®. Such an amino acid sequence of the invention is preferably an amino acid sequence that is directed against the Herceptin® binding site on HER2 (and in particular against domain IV of HER2, and more in particular against the C-terminus of domain IV of HER2) and/or capable of competing with Herceptin® for binding to HER-2.

Again, such a biparatopic (or multiparatopic) polypeptide of the invention may be as further described herein, and the various preferred aspects of the invention as described herein also apply to these biparatopic (or multiparatopic) polypeptides of the invention (for example, these biparatopic and multiparatopic polypeptides of the invention may comprise suitable linkers; are preferably such that they can simultaneously bind at least two different antigenic determinants, epitopes, parts or domains or HER-2, such as the Omnitarg binding site and the Herceptin®-binding site; and preferably comprise single variable domains and more preferably Nanobodies).

In another preferred, but non-limiting aspect, the amino acid sequences and (in particular) polypeptides of the invention are biparatopic (or multiparatopic) and are at least capable, upon binding to HER-2, (A) to modulate (as defined herein) HER-2 or HER-2 mediated signalling by inhibiting ligand activation of an ErbB hetero-oligomer comprising HER2 and HER3, HER4 or EGFR, or more generally capable of modulating (as defined herein) HER-2 or HER-2 mediated signalling via the same mechanism of action as Omnitarg; and (B) to bind to the Herceptin® binding site on HER2 (and in particular to domain IV of HER2, and more in particular to the C-terminus of domain IV of HER2) and/or to compete with Herceptin® for binding to HER-2.

For example, for this purpose, such a biparatopic (or multiparatopic) polypeptide of the invention may comprise
at least one first amino acid sequence of the invention that is capable, upon binding to HER-2, to modulate (as defined herein) HER-2 or HER-2 mediated signalling by inhibiting ligand activation of an ErbB hetero-oligomer comprising HER2 and HER3, HER4 or EGFR, or more generally capable of modulating (as defined herein) HER-2 or HER-2 mediated signalling via the same mechanism of action as Omnitarg;
and further comprise either
at least one amino acid sequence of the invention that is directed against the Herceptin® binding site on HER2 (and in particular against domain IV of HER2, and more in particular against the C-terminus of domain IV of HER2) and/or capable of competing with Herceptin® for binding to HER-2.

Again, such a biparatopic (or multiparatopic) polypeptide of the invention may be as further described herein, and the various preferred aspects of the invention as described herein also apply to these biparatopic (or multiparatopic) polypeptides of the invention (for example, these biparatopic and multiparatopic polypeptides of the invention may comprise suitable linkers; are preferably such that they can simultaneously bind at least two different antigenic determinants, epitopes, parts or domains or HER-2, at least including the Herceptin®-binding site; and preferably comprise single variable domains and more preferably Nanobodies).

In another preferred, but non-limiting aspect, the amino acid sequences and (in particular) polypeptides of the invention are biparatopic (or multiparatopic) and are at least capable, upon binding to HER-2, (A) to bind to the Omnitarg binding site on HER2 (and in particular to domain II of HER2, and more in particular to the middle of domain II of HER2) and/or capable of competing with Omnitarg for binding to HER-2; and (B) to (i) recruit immune effector cells such as macrophages and monocytes to the tumor (for this purpose, most preferably a polypeptide of the invention is used that contains an Fc portion that confers upon the polypeptide the ability to recruit immune effector cells such as macrophages and monocytes to the tumor); and/or (ii) modulate (as defined herein) HER-2 or HER-2 mediated signalling by downregulating HER2 levels and/or by downregulating HER2-mediated signaling pathways; and/or (iii) modulate (as defined herein) HER-2 or HER-2 mediated signalling by blocking or inhibiting metalloproteinase-mediated HER2 ectodomain shedding; or more generally by modulating (as defined herein) HER-2 or HER-2 mediated signalling via the same mechanism of action as Herceptin®.

For example, for this purpose, such a biparatopic (or multiparatopic) polypeptide of the invention may comprise:
at least one first amino acid sequence of the invention that is directed against the Omnitarg binding site on HER2 (and in particular against domain II of HER2, and more in particular against the middle of domain II of HER2) and/or capable of competing with Omnitarg for binding to HER-2;
and further comprise either
an Fc portion that confers upon the polypeptide the ability to recruit immune effector cells such as macrophages and monocytes to the tumor),
and/or
at least one amino acid sequence of the invention that is capable, upon binding to HER-2, to (1) modulate (as defined herein) HER-2 or HER-2 mediated signalling by downregulating HER2 levels and/or by downregulating HER2-mediated signaling pathways; and/or (2) modulate (as defined herein) HER-2 or HER-2 mediated signalling by blocking or inhibiting metalloproteinase-mediated HER2 ectodomain shedding; or more generally (3) modulate (as defined herein) HER-2 or HER-2 mediated signalling via the same mechanism of action as Herceptin®. Such an amino acid sequence of the invention is preferably an amino acid sequence that is directed against the Herceptin® binding site on HER2 (and in particular against domain IV of HER2, and more in particular against the C-terminus of domain IV of HER2) and/or capable of competing with Herceptin® for binding to HER-2.

Again, such a biparatopic (or multiparatopic) polypeptide of the invention may be as further described herein, and the various preferred aspects of the invention as described herein also apply to these biparatopic (or multiparatopic) polypeptides of the invention (for example, these biparatopic and multiparatopic polypeptides of the invention may comprise suitable linkers; are preferably such that they can simultaneously bind at least two different antigenic determinants, epitopes, parts or domains or HER-2, at least including the Omnitarg binding site; and preferably comprise single variable domains and more preferably Nanobodies).

It is also expected that the amino acid sequences and polypeptides of the invention will generally bind to all naturally occurring or synthetic analogs, variants, mutants, alleles, parts and fragments of HER2; or at least to those analogs, variants, mutants, alleles, parts and fragments of HER2 that contain one or more antigenic determinants or epitopes that are essentially the same as the antigenic determinant(s) or epitope(s) to which the amino acid sequences and polypeptides of the invention bind in HER2 (e.g. in wild-type HER2). Again, in such a case, the amino acid sequences and polypeptides of the invention may bind to such analogs, variants, mutants, alleles, parts and fragments with an affinity and/or specificity that are the same as, or that are different from (i.e. higher than or lower than), the affinity and specificity with which the amino acid sequences of the invention bind to (wild-type) HER2. It is also included within the scope of the invention that the amino acid sequences and polypeptides of the invention bind to some analogs, variants, mutants, alleles, parts and fragments of HER2, but not to others.

When HER2 exists in a monomeric form and in one or more multimeric forms, it is within the scope of the invention that the amino acid sequences and polypeptides of the invention only bind to HER2 in monomeric form, only bind to HER2 in multimeric form, or bind to both the monomeric and the multimeric form. Again, in such a case, the amino acid sequences and polypeptides of the invention may bind to the monomeric form with an affinity and/or specificity that are the same as, or that are different from (i.e. higher than or lower than), the affinity and specificity with which the amino acid sequences of the invention bind to the multimeric form.

In a non-limiting aspect, the amino acid sequences and polypeptides of the invention only bind to HER2 in monomeric form while not binding to HER2 in dimerized state. In another non-limiting aspect, the amino acid sequences and polypeptides of the invention only bind to HER2 in dimerized state while not binding to HER2 in monomeric form. In another non-limiting aspect, the amino acid sequences and polypeptides of the invention bind to HER2 in monomeric form as well as to HER2 in dimerized state.

Also, when HER2 can associate with other proteins or polypeptides (e.g. with other ERBB receptors, also referred to as heterodimerization) to form protein complexes (e.g. with multiple subunits), it is within the scope of the invention that the amino acid sequences and polypeptides of the invention bind to HER2 in its non-associated state, bind HER2 in its associated state, or bind to both. In a non-limiting aspect, the amino acid sequences and polypeptides of the invention only bind to HER2 when HER-2 is in its monomeric form while not binding to HER2 when HER-2 is in its dimerized state. In another non-limiting aspect, the amino acid sequences and polypeptides of the invention only bind to HER2 when HER-2 is in its dimerized state while not binding to HER2 when HER-2 is in monomeric form. In another non-limiting aspect, the amino acid sequences and polypeptides of the invention bind to HER2 in monomeric form as well as to HER2 in dimerized state. In all these cases, the amino acid sequences and polypeptides of the invention may bind to such multimers or associated protein complexes with an affinity and/or specificity that may be the same as or different from (i.e. higher than or lower than) the affinity and/or specificity with which the amino acid sequences and polypeptides of the invention bind to HER2 in its monomeric and non-associated state.

Also, as will be clear to the skilled person, proteins or polypeptides that contain two or more amino acid sequences directed against HER2 may bind with higher avidity to HER2 than the corresponding monomeric amino acid sequence(s). For example, and without limitation, proteins or polypeptides that contain two or more amino acid sequences directed against different epitopes of HER2 may (and usually will) bind with higher avidity than each of the different monomers, and proteins or polypeptides that contain two or more amino acid sequences directed against HER2 may (and usually will) bind also with higher avidity to a multimer of HER2.

Generally, amino acid sequences and polypeptides of the invention will at least bind to those forms of HER2 (including monomeric, multimeric and associated forms) that are the most relevant from a biological and/or therapeutic point of view, as will be clear to the skilled person.

It is also within the scope of the invention to use parts, fragments, analogs, mutants, variants, alleles and/or derivatives of the amino acid sequences and polypeptides of the invention, and/or to use proteins or polypeptides comprising or essentially consisting of one or more of such parts, fragments, analogs, mutants, variants, alleles and/or derivatives, as long as these are suitable for the uses envisaged herein.

Such parts, fragments, analogs, mutants, variants, alleles and/or derivatives will usually contain (at least part of) a functional antigen-binding site for binding against HER2; and more preferably will be capable of specific binding to HER2, and even more preferably capable of binding to HER2 with an affinity (suitably measured and/or expressed as a $K_D$-value (actual or apparent), a $K_A$-value (actual or apparent), a $k_{on}$-rate and/or a $k_{off}$-rate, or alternatively as an $IC_{50}$ value, as further described herein) that is as defined herein. Some non-limiting examples of such parts, fragments, analogs, mutants, variants, alleles, derivatives, proteins and/or polypeptides will become clear from the further description herein. Additional fragments or polypeptides of the invention may also be provided by suitably combining (i.e. by linking or genetic fusion) one or more (smaller) parts or fragments as described herein.

In one specific, but non-limiting aspect of the invention, which will be further described herein, such analogs, mutants, variants, alleles, derivatives have an increased half-life in serum (as further described herein) compared to the amino acid sequence from which they have been derived. For example, an amino acid sequence of the invention may be linked (chemically or otherwise) to one or more groups or moieties that extend the half-life (such as PEG), so as to provide a derivative of an amino acid sequence of the invention with increased half-life.

In one specific, but non-limiting aspect, the amino acid sequence of the invention may be an amino acid sequence that comprises an immunoglobulin fold or may be an amino acid sequence that, under suitable conditions (such as physiological conditions) is capable of forming an immunoglobulin fold (i.e. by folding). Reference is inter alia made to the review by Halaby et al., J. (1999) Protein Eng. 12, 563-71. Preferably, when properly folded so as to form an immunoglobulin fold, such an amino acid sequence is capable of specific binding (as defined herein) to HER2; and more preferably capable of binding to HER2 with an affinity (suitably measured and/or expressed as a $K_D$-value (actual or apparent), a $K_A$-value (actual or apparent), a $k_{on}$-rate and/or a $k_{off}$-rate, or alternatively as an $IC_{50}$ value, as further described herein) that is as defined herein. Also, parts, fragments, analogs, mutants, variants, alleles and/or derivatives of such amino acid sequences are preferably such that they comprise an immunoglobulin fold or are capable for forming, under suitable conditions, an immunoglobulin fold.

In particular, but without limitation, the amino acid sequences of the invention may be amino acid sequences that essentially consist of 4 framework regions (FR1 to FR4 respectively) and 3 complementarity determining regions (CDR1 to CDR3 respectively); or any suitable fragment of such an amino acid sequence (which will then usually contain at least some of the amino acid residues that form at least one of the CDR's, as further described herein).

The amino acid sequences of the invention may in particular be an immunoglobulin sequence or a suitable fragment thereof, and more in particular be an immunoglobulin variable domain sequence or a suitable fragment thereof, such as light chain variable domain sequence (e.g. a $V_L$-sequence) or a suitable fragment thereof; or a heavy chain variable domain sequence (e.g. a $V_H$-sequence) or a suitable fragment thereof. When the amino acid sequence of the invention is a heavy chain variable domain sequence, it may be a heavy chain variable domain sequence that is derived from a conventional four-chain antibody (such as, without limitation, a $V_H$ sequence that is derived from a human antibody) or be a so-called. $V_{HH}$-sequence (as defined herein) that is derived from a so-called "heavy chain antibody" (as defined herein).

However, it should be noted that the invention is not limited as to the origin of the amino acid sequence of the invention (or of the nucleotide sequence of the invention used to express it), nor as to the way that the amino acid sequence or nucleotide sequence of the invention is (or has been) generated or obtained. Thus, the amino acid sequences of the invention may be naturally occurring amino acid sequences (from any suitable species) or synthetic or semi-synthetic amino acid sequences. In a specific but non-limiting aspect of the invention, the amino acid sequence is a naturally occurring immunoglobulin sequence (from any suitable species) or a synthetic or semi-synthetic immunoglobulin sequence, including but not limited to "humanized" (as defined herein) immunoglobulin sequences (such as partially or fully humanized mouse or rabbit immunoglobulin sequences, and in particular partially or fully humanized $V_{HH}$ sequences or Nanobodies), "camelized" (as defined herein) immunoglobulin sequences, as well as immunoglobulin sequences that have been obtained by techniques such as affinity maturation (for example, starting from synthetic, random or naturally occurring immunoglobulin sequences), CDR grafting, veneering, combining fragments derived from different immunoglobulin sequences, PCR assembly using overlapping primers, and similar techniques for engineering immunoglobulin sequences well known to the skilled person; or any suitable combination of any of the foregoing. Reference is for example made to the standard handbooks, as well as to the further description and prior art mentioned herein.

Similarly, the nucleotide sequences of the invention may be naturally occurring nucleotide sequences or synthetic or semi-synthetic sequences, and may for example be sequences that are isolated by PCR from a suitable naturally occurring template (e.g. DNA or RNA isolated from a cell), nucleotide sequences that have been isolated from a library (and in particular, an expression library), nucleotide sequences that have been prepared by introducing mutations into a naturally occurring nucleotide sequence (using any suitable technique known per se, such as mismatch PCR), nucleotide sequence that have been prepared by PCR using overlapping primers, or nucleotide sequences that have been prepared using techniques for DNA synthesis known per se.

The amino acid sequence of the invention may in particular be a domain antibody (or an amino acid sequence that is suitable for use as a domain antibody), a single domain antibody (or an amino acid sequence that is suitable for use as a single domain antibody), a "dAb" (or an amino acid sequence that is suitable for use as a dAb) or a Nanobody® (as defined herein, and including but not limited to a $V_{HH}$ sequence); other single variable domains, or any suitable fragment of any one thereof. For a general description of (single) domain antibodies, reference is also made to the prior art cited above, as well as to EP 0 368 684. For the term "dAb's", reference is for example made to Ward et al. (Nature 1989 Oct. 12; 341 (6242): 544-6), to Holt et al., Trends Biotechnol., 2003, 21(11):484-490; as well as to for example WO 06/030220, WO 06/003388 and other published patent applications of Domantis Ltd. It should also be noted that, although less preferred in the context of the present invention because they are not of mammalian origin, single domain antibodies or single variable domains can be derived from certain species of shark (for example, the so-called "IgNAR domains", see for example WO 05/18629).

In particular, the amino acid sequence of the invention may be a Nanobody® (as defined herein) or a suitable fragment thereof. [Note: Nanobody®, Nanobodies® and Nanoclone® are registered trademarks of Ablynx N.V.] Such Nanobodies directed against HER2 will also be referred to herein as "Nanobodies of the invention".

For a general description of Nanobodies, reference is made to the further description below, as well as to the prior art cited herein. In this respect, it should however be noted that this description and the prior art mainly described Nanobodies of the so-called "$V_H 3$ class" (i.e. Nanobodies with a high degree of sequence homology to human germline sequences of the $V_H 3$ class such as DP-47, DP-51 or DP-29), which Nanobodies form a preferred aspect of this invention. It should however be noted that the invention in its broadest sense generally covers any type of Nanobody directed against HER2, and for example also covers the Nanobodies belonging to the so-called "$V_H 4$ class" (i.e. Nanobodies with a high degree of sequence homology to human germline sequences of the $V_H 4$ class such as DP-78), as for example described in WO 07/118, 670.

Generally, Nanobodies (in particular $V_{HH}$ sequences and partially humanized Nanobodies) can in particular be characterized by the presence of one or more "Hallmark residues" (as described herein) in one or more of the framework sequences (again as further described herein).

Thus, generally, a Nanobody can be defined as an amino acid sequence with the (general) structure

FR1-CDR1-FR2-CDR2-FR3-CDR3-FR4 in which FR1 to FR4 refer to framework regions 1 to 4, respectively, and in which CDR1 to CDR3 refer to the complementarity determining regions 1 to 3, respectively, and in which one or more of the Hallmark residues are as further defined herein.

In particular, a Nanobody can be an amino acid sequence with the (general) structure

FR1-CDR1-FR2-CDR2-FR3-CDR3-FR4 in which FR1 to FR4 refer to framework regions 1 to 4, respectively, and in which CDR1 to CDR3 refer to the complementarity determining regions 1 to 3, respectively, and in which the framework sequences are as further defined herein.

More in particular, a Nanobody can be an amino acid sequence with the (general) structure

FR1-CDR1-FR2-CDR2-FR3-CDR3-FR4 in which FR1 to FR4 refer to framework regions 1 to 4, respectively, and in which CDR1 to CDR3 refer to the complementarity determining regions 1 to 3, respectively, and in which:
i) preferably one or more of the amino acid residues at positions 11, 37, 44, 45, 47, 83, 84, 103, 104 and 108 according to the Kabat numbering are chosen from the Hallmark residues mentioned in Table A-3 below;
and in which:
ii) said amino acid sequence has at least 80% amino acid identity with at least one of the amino acid sequences of SEQ ID NOs: 1 to 22, in which for the purposes of determining the degree of amino acid identity, the amino acid residues that form the CDR sequences (indicated with X in the sequences of SEQ ID NOs: 1 to 22) are disregarded.

In these Nanobodies, the CDR sequences are generally as further defined herein.

Thus, the invention also relates to such Nanobodies that can bind to (as defined herein) and/or are directed against HER2, to suitable fragments thereof, as well as to polypeptides that comprise or essentially consist of one or more of such Nanobodies and/or suitable fragments.

SEQ ID NOs: 2051-2325 give the amino acid sequences of a number of $V_{HH}$ sequences that have been raised against HER2.

In particular, the invention in some specific aspects provides:
- amino acid sequences that are directed against (as defined herein) HER2 and that have at least 80%, preferably at least 85%, such as 90% or 95% or more sequence identity with at least one of the amino acid sequences of SEQ ID NO's: 2051-2325. These amino acid sequences may further be such that they are directed against an interaction site (as defined herein) on HER2 (such as the Herceptin® or Omnitarg binding site);
- amino acid sequences that cross-block (as defined herein) the binding of at least one of the amino acid sequences of SEQ ID NO's: 2051-2325 to HER2 and/or that compete with at least one of the amino acid sequences of SEQ ID NO's: 2051-2325 for binding to HER2. Again, these amino acid sequences may further be such that they are directed against an interaction site (as defined herein) on HER2 (such as Herceptin® or Omnitarg binding site);

which amino acid sequences may be as further described herein (and may for example be Nanobodies); as well as polypeptides of the invention that comprise one or more of such amino acid sequences (which may be as further described herein, and may for example be bispecific and/or biparatopic polypeptides as described herein), and nucleic acid sequences that encode such amino acid sequences and polypeptides. Such amino acid sequences and polypeptides do not include any naturally occurring ligands.

Accordingly, some particularly preferred Nanobodies of the invention are Nanobodies which can bind (as further defined herein) to and/or are directed against to HER2 and which:

i) have at least 80% amino acid identity with at least one of the amino acid sequences of SEQ ID NOs: 2051-2325, in which for the purposes of determining the degree of amino acid identity, the amino acid residues that form the CDR sequences are disregarded. In this respect, reference is also made to Table A-1, which lists the framework 1 sequences (SEQ ID NOs: 126-400), framework 2 sequences (SEQ ID NOs: 676-950), framework 3 sequences (SEQ ID NOs: 1226-1500) and framework 4 sequences (SEQ ID NOs: 1776-2050) of the Nanobodies of SEQ ID NOs: 2051-2325 (with respect to the amino acid residues at positions 1 to 4 and 27 to 30 of the framework 1 sequences, reference is also made to the comments made below. Thus, for determining the degree of amino acid identity, these residues are preferably disregarded);

and in which:

ii) preferably one or more of the amino acid residues at positions 11, 37, 44, 45, 47, 83, 84, 103, 104 and 108 according to the Kabat numbering are chosen from the Hallmark residues mentioned in Table A-3 below.

In these Nanobodies, the CDR sequences are generally as further defined herein.

Again, such Nanobodies may be derived in any suitable manner and from any suitable source, and may for example be naturally occurring $V_{HH}$ sequences (i.e. from a suitable species of Camelid) or synthetic or semi-synthetic amino acid sequences, including but not limited to "humanized" (as defined herein) Nanobodies, "camelized" (as defined herein) immunoglobulin sequences (and in particular camelized heavy chain variable domain sequences), as well as Nanobodies that have been obtained by techniques such as affinity maturation (for example, starting from synthetic, random or naturally occurring immunoglobulin sequences), CDR grafting, veneering, combining fragments derived from different immunoglobulin sequences, PCR assembly using overlapping primers, and similar techniques for engineering immunoglobulin sequences well known to the skilled person; or any suitable combination of any of the foregoing as further described herein. Also, when a Nanobody comprises a $V_{HH}$ sequence, said Nanobody may be suitably humanized, as further described herein, so as to provide one or more further (partially or fully) humanized Nanobodies of the invention. Similarly, when a Nanobody comprises a synthetic or semi-synthetic sequence (such as a partially humanized sequence), said Nanobody may optionally be further suitably humanized, again as described herein, again so as to provide one or more further (partially or fully) humanized Nanobodies of the invention.

In particular, humanized Nanobodies may be amino acid sequences that are as generally defined for Nanobodies in the previous paragraphs, but in which at least one amino acid residue is present (and in particular, in at least one of the framework residues) that is and/or that corresponds to a humanizing substitution (as defined herein). Some preferred, but non-limiting humanizing substitutions (and suitable combinations thereof) will become clear to the skilled person based on the disclosure herein. In addition, or alternatively, other potentially useful humanizing substitutions can be ascertained by comparing the sequence of the framework regions of a naturally occurring $V_{HH}$ sequence with the corresponding framework sequence of one or more closely related human $V_H$ sequences, after which one or more of the potentially useful humanizing substitutions (or combinations thereof) thus determined can be introduced into said sequence (in any manner known per se, as further described herein) and the resulting humanized $V_{HH}$ sequences can be tested for affinity for the target, for stability, for ease and level of expression, and/or for other desired properties. In this way, by means of a limited degree of trial and error, other suitable humanizing substitutions (or suitable combinations thereof) can be determined by the skilled person based on the disclosure herein. Also, based on the foregoing, (the framework regions of) a Nanobody may be partially humanized or fully humanized.

Some particularly preferred humanized Nanobodies of the invention are humanized variants of the Nanobodies of SEQ ID NOs: 2051-2325.

Thus, some other preferred Nanobodies of the invention are Nanobodies which can bind (as further defined herein) to HER2 and which:

i) are a humanized variant of one of the amino acid sequences of SEQ ID NOs: 2051-2325; and/or ii) have at least 80% amino acid identity with at least one of the amino acid sequences of SEQ ID NOs: 2051-2325, in which for the purposes of determining the degree of amino acid identity, the amino acid residues that form the CDR sequences are disregarded;

and in which:

i) preferably one or more of the amino acid residues at positions 11, 37, 44, 45, 47, 83, 84, 103, 104 and 108 according to the Kabat numbering are chosen from the Hallmark residues mentioned in Table A-3 below.

According to another specific aspect of the invention, the invention provides a number of stretches of amino acid residues (i.e. small peptides) that are particularly suited for binding to HER2. These stretches of amino acid residues may be present in, and/or may be corporated into, an amino acid sequence of the invention, in particular in such a way that they form (part of) the antigen binding site of an amino acid sequence of the invention. As these stretches of amino acid residues were first generated as CDR sequences of heavy chain antibodies or $V_{HH}$ sequences that were raised against HER2 (or may be based on and/or derived from such CDR sequences, as further described herein), they will also generally be referred to herein as "CDR sequences" (i.e. as CDR1 sequences, CDR2 sequences and CDR3 sequences, respectively). It should however be noted that the invention in its broadest sense is not limited to a specific structural role or function that these stretches of amino acid residues may have in an amino acid sequence of the invention, as long as these stretches of amino acid residues allow the amino acid sequence of the invention to bind to HER2. Thus, generally, the invention in its broadest sense comprises any amino acid sequence that is capable of binding to HER2 and that comprises one or more CDR sequences as described herein, and in particular a suitable combination of two or more such CDR sequences, that are suitably linked to each other via one or more further amino acid sequences, such that the entire amino acid sequence forms a binding domain and/or binding unit that is capable of binding to HER2. It should however also be noted that the presence of only one such CDR sequence in an amino acid sequence of the invention may by itself already be sufficient to provide an amino acid sequence of the invention that is capable of binding to HER2; reference is for example again made to the so-called "Expedite fragments" described in WO 03/050531.

Thus, in another specific, but non-limiting aspect, the amino acid sequence of the invention may be an amino acid sequence that comprises at least one amino acid sequence that is chosen from the group consisting of the CDR1 sequences, CDR2 sequences and CDR3 sequences that are described herein (or any suitable combination thereof). In particular, an amino acid sequence of the invention may be an amino acid sequence that comprises at least one antigen binding site, wherein said antigen binding site comprises at least one amino acid sequence that is chosen from the group consisting of the CDR1 sequences, CDR2 sequences and CDR3 sequences that are described herein (or any suitable combination thereof).

Generally, in this aspect of the invention, the amino acid sequence of the invention may be any amino acid sequence that comprises at least one stretch of amino acid residues, in which said stretch of amino acid residues has an amino acid sequence that corresponds to the sequence of at least one of the CDR sequences described herein. Such an amino acid sequence may or may not comprise an immunoglobulin fold. For example, and without limitation, such an amino acid sequence may be a suitable fragment of an immunoglobulin sequence that comprises at least one such CDR sequence, but that is not large enough to form a (complete) immunoglobulin fold (reference is for example again made to the "Expedite fragments" described in WO 03/050531). Alternatively, such an amino acid sequence may be a suitable "protein scaffold" that comprises least one stretch of amino acid residues that corresponds to such a CDR sequence (i.e. as part of its antigen binding site). Suitable scaffolds for presenting amino acid sequences will be clear to the skilled person, and for example comprise, without limitation, to binding scaffolds based on or derived from immunoglobulins (i.e. other than the immunoglobulin sequences already described herein), protein scaffolds derived from protein A domains (such as Affibodies™), tendamistat, fibronectin, lipocalin, CTLA-4, T-cell receptors, designed ankyrin repeats, avimers and PDZ domains (Binz et al., Nat. Biotech 2005, Vol 23:1257), and binding moieties based on DNA or RNA including but not limited to DNA or RNA aptamers (Ulrich et al., Comb Chem High Throughput Screen 2006 9(8):619-32).

Again, any amino acid sequence of the invention that comprises one or more of these CDR sequences is preferably such that it can specifically bind (as defined herein) to HER2, and more in particular such that it can bind to HER2 with an affinity (suitably measured and/or expressed as a $K_D$-value (actual or apparent), a $K_A$-value (actual or apparent), a $k_{on}$-rate and/or a $k_{off}$-rate, or alternatively as an $IC_{50}$ value, as further described herein), that is as defined herein.

More in particular, the amino acid sequences according to this aspect of the invention may be any amino acid sequence that comprises at least one antigen binding site, wherein said antigen binding site comprises at least two amino acid sequences that are chosen from the group consisting of the CDR1 sequences described herein, the CDR2 sequences described herein and the CDR3 sequences described herein, such that (i) when the first amino acid sequence is chosen from the CDR1 sequences described herein, the second amino acid sequence is chosen from the CDR2 sequences described herein or the CDR3 sequences described herein; (ii) when the first amino acid sequence is chosen from the CDR2 sequences described herein, the second amino acid sequence is chosen from the CDR1 sequences described herein or the CDR3 sequences described herein; or (iii) when the first amino acid sequence is chosen from the CDR3 sequences described herein, the second amino acid sequence is chosen from the CDR 1 sequences described herein or the CDR3 sequences described herein.

Even more in particular, the amino acid sequences of the invention may be amino acid sequences that comprise at least one antigen binding site, wherein said antigen binding site comprises at least three amino acid sequences that are chosen from the group consisting of the CDR1 sequences described herein, the CDR2 sequences described herein and the CDR3 sequences described herein, such that the first amino acid sequence is chosen from the CDR1 sequences described herein, the second amino acid sequence is chosen from the CDR2 sequences described herein, and the third amino acid sequence is chosen from the CDR3 sequences described herein. Preferred combinations of CDR1, CDR2 and CDR3 sequences will become clear from the further description herein. As will be clear to the skilled person, such an amino acid sequence is preferably an immunoglobulin sequence (as further described herein), but it may for example also be any other amino acid sequence that comprises a suitable scaffold for presenting said CDR sequences.

Thus, in one specific, but non-limiting aspect, the invention relates to an amino acid sequence directed against HER2, that comprises one or more stretches of amino acid residues chosen from the group consisting of:
a) the amino acid sequences of SEQ ID NO's: 401-675;
b) amino acid sequences that have at least 80% amino acid identity with at least one of the amino acid sequences of SEQ ID NO's: 401-675;
c) amino acid sequences that have 3, 2, or 1 amino acid difference with at least one of the amino acid sequences of SEQ ID NO's: 401-675;
d) the amino acid sequences of SEQ ID NO's: 951-1225;
e) amino acid sequences that have at least 80% amino acid identity with at least one of the amino acid sequences of SEQ ID NO's: 951-1225;
f) amino acid sequences that have 3, 2, or 1 amino acid difference with at least one of the amino acid sequences of SEQ ID NO's: 951-1225;
g) the amino acid sequences of SEQ ID NO's: 1501-1775;
h) amino acid sequences that have at least 80% amino acid identity with at least one of the amino acid sequences of SEQ ID NO's: 1501-1775;
i) amino acid sequences that have 3, 2, or 1 amino acid difference with at least one of the amino acid sequences of SEQ ID NO's: 1501-1775;
or any suitable combination thereof.

When an amino acid sequence of the invention contains one or more amino acid sequences according to b) and/or c):
i) any amino acid substitution in such an amino acid sequence according to b) and/or c) is preferably, and compared to the corresponding amino acid sequence according to a), a conservative amino acid substitution, (as defined herein);
and/or
ii) the amino acid sequence according to b) and/or c) preferably only contains amino acid substitutions, and no amino acid deletions or insertions, compared to the corresponding amino acid sequence according to a);
and/or
iii) the amino acid sequence according to b) and/or c) may be an amino acid sequence that is derived from an amino acid sequence according to a) by means of affinity maturation using one or more techniques of affinity maturation known per se.

Similarly, when an amino acid sequence of the invention contains one or more amino acid sequences according to e) and/or f):
i) any amino acid substitution in such an amino acid sequence according to e) and/or f) is preferably, and compared to the corresponding amino acid sequence according to d), a conservative amino acid substitution, (as defined herein);
and/or
ii) the amino acid sequence according to e) and/or f) preferably only contains amino acid substitutions, and no amino acid deletions or insertions, compared to the corresponding amino acid sequence according to d);
and/or
iii) the amino acid sequence according to e) and/or f) may be an amino acid sequence that is derived from an amino acid sequence according to d) by means of affinity maturation using one or more techniques of affinity maturation known per se.

Also, similarly, when an amino acid sequence of the invention contains one or more amino acid sequences according to h) and/or i):
i) any amino acid substitution in such an amino acid sequence according to h) and/or i) is preferably, and compared to the corresponding amino acid sequence according to g), a conservative amino acid substitution, (as defined herein);
and/or
ii) the amino acid sequence according to h) and/or i) preferably only contains amino acid substitutions, and no amino acid deletions or insertions, compared to the corresponding amino acid sequence according to g);
and/or
iii) the amino acid sequence according to h) and/or i) may be an amino acid sequence that is derived from an amino acid sequence according to g) by means of affinity maturation using one or more techniques of affinity maturation known per se.

It should be understood that the last preceding paragraphs also generally apply to any amino acid sequences of the invention that comprise one or more amino acid sequences according to b), c), e), f), h) or i), respectively.

In this specific aspect, the amino acid sequence preferably comprises one or more stretches of amino acid residues chosen from the group consisting of:
i) the amino acid sequences of SEQ ID NO's: 401-675;
ii) the amino acid sequences of SEQ ID NO's: 951-1225; and
iii) the amino acid sequences of SEQ ID NO's: 1501-1775;
or any suitable combination thereof.

Also, preferably, in such an amino acid sequence, at least one of said stretches of amino acid residues forms part of the antigen binding site for binding against HER2.

In a more specific, but again non-limiting aspect, the invention relates to an amino acid sequence directed against HER2, that comprises two or more stretches of amino acid residues chosen from the group consisting of:
a) the amino acid sequences of SEQ ID NO's: 401-675;
b) amino acid sequences that have at least 80% amino acid identity with at least one of the amino acid sequences of SEQ ID NO's: 401-675;
c) amino acid sequences that have 3, 2, or 1 amino acid difference with at least one of the amino acid sequences of SEQ ID NO's: 401-675;
d) the amino acid sequences of SEQ ID NO's: 951-1225;
e) amino acid sequences that have at least 80% amino acid identity with at least one of the amino acid sequences of SEQ ID NO's: 951-1225;
f) amino acid sequences that have 3, 2, or 1 amino acid difference with at least one of the amino acid sequences of SEQ ID NO's: 951-1225;
g) the amino acid sequences of SEQ ID NO's: 1501-1775;
h) amino acid sequences that have at least 80% amino acid identity with at least one of the amino acid sequences of SEQ ID NO's: 1501-1775;
i) amino acid sequences that have 3, 2, or 1 amino acid difference with at least one of the amino acid sequences of SEQ ID NO's: 1501-1775;
such that (i) when the first stretch of amino acid residues corresponds to one of the amino acid sequences according to a), b) or c), the second stretch of amino acid residues corresponds to one of the amino acid sequences according to d), e), g), h) or i); (ii) when the first stretch of amino acid residues corresponds to one of the amino acid sequences according to d), e) or f), the second stretch of amino acid residues corresponds to one of the amino acid sequences according to a), b), c), g), h) or i); or (iii) when the first stretch of amino acid residues corresponds to one of the amino acid sequences according to g), h) or i), the second stretch of amino acid residues corresponds to one of the amino acid sequences according to a), b), c), d), e) or f).

In this specific aspect, the amino acid sequence preferably comprises two or more stretches of amino acid residues chosen from the group consisting of:
i) the amino acid sequences of SEQ ID NO's: 401-675;
ii) the amino acid sequences of SEQ ID NO's: 951-1225; and
iii) the amino acid sequences of SEQ ID NO's: 1501-1775;
such that, (i) when the first stretch of amino acid residues corresponds to one of the amino acid sequences of SEQ ID NO's: 401-675, the second stretch of amino acid residues corresponds to one of the amino acid sequences of SEQ ID NO's: 951-1225 or of SEQ ID NO's: 1501-1775; (ii) when the first stretch of amino acid residues corresponds to one of the amino acid sequences of SEQ ID NO's: 951-1225, the second stretch of amino acid residues corresponds to one of the amino acid sequences of SEQ ID NO's: 401-675 or of SEQ ID NO's: 1501-1775; or (iii) when the first stretch of amino acid residues corresponds to one of the amino acid sequences of SEQ ID NO's: 1501-1775, the second stretch of amino acid residues corresponds to one of the amino acid sequences of SEQ ID NO's: 401-675 or of SEQ ID NO's: 951-1225.

Also, in such an amino acid sequence, the at least two stretches of amino acid residues again preferably form part of the antigen binding site for binding against HER2.

In an even more specific, but non-limiting aspect, the invention relates to an amino acid sequence directed against HER2, that comprises three or more stretches of amino acid residues, in which the first stretch of amino acid residues is chosen from the group consisting of:
a) the amino acid sequences of SEQ ID NO's: 401-675;
b) amino acid sequences that have at least 80% amino acid identity with at least one of the amino acid sequences of SEQ ID NO's: 401-675;
c) amino acid sequences that have 3, 2, or 1 amino acid difference with, at least one of the amino acid sequences of SEQ ID NO's: 401-675;
the second stretch of amino acid residues is chosen from the group consisting of:
d) the amino acid sequences of SEQ ID NO's: 951-1225;
e) amino acid sequences that have at least 80% amino acid identity with at least one of the amino acid sequences of SEQ ID NO's: 951-1225;
f) amino acid sequences that have 3, 2, or 1 amino acid difference with at least one of the amino acid sequences of SEQ ID NO's: 951-1225;
and the third stretch of amino acid residues is chosen from the group consisting of:
g) the amino acid sequences of SEQ ID NO's: 1501-1775;
h) amino acid sequences that have at least 80% amino acid identity with at least one of the amino acid sequences of SEQ ID NO's: 1501-1775;
i) amino acid sequences that have 3, 2, or 1 amino acid difference with at least one of the amino acid sequences of SEQ ID NO's: 1501-1775.

Preferably, in this specific aspect, the first stretch of amino acid residues is chosen from the group consisting of the amino acid sequences of SEQ ID NO's: 401-675; the second stretch of amino acid residues is chosen from the group consisting of the amino acid sequences of SEQ ID NO's: 951-1225; and the third stretch of amino acid residues is chosen from the group consisting of the amino acid sequences of SEQ ID NO's: 1501-1775.

Again, preferably, in such an amino acid sequence, the at least three stretches of amino acid residues forms part of the antigen binding site for binding against HER2. Preferred combinations of such stretches of amino acid sequences will become clear from the further disclosure herein.

Preferably, in such amino acid sequences the CDR sequences have at least 70% amino acid identity, preferably at least 80% amino acid identity, more preferably at least 90% amino acid identity, such as 95% amino acid identity or more or even essentially 100% amino acid identity with the CDR sequences of at least one of the amino acid sequences of SEQ ID NO's: 2051-2325. This degree of amino acid identity can for example be determined by determining the degree of amino acid identity (in a manner described herein) between said amino acid sequence and one or more of the sequences of SEQ ID NO's: 2051-2325, in which the amino acid residues that form the framework regions are disregarded. Also, such amino acid sequences of the invention can be as further described herein.

Also, such amino acid sequences are preferably such that they can specifically bind (as defined herein) to HER2; and more in particular bind to HER2 with an affinity (suitably measured and/or expressed as a $K_D$-value (actual or apparent), a $K_A$-value (actual or apparent), a $k_{on}$-rate and/or a $k_{off}$-rate, or alternatively as an $IC_{50}$ value, as further described herein) that is as defined herein.

When the amino acid sequence of the invention essentially consists of 4 framework regions (FR1 to FR4, respectively) and 3 complementarity determining regions (CDR1 to CDR3, respectively), the amino acid sequence of the invention is preferably such that:

CDR1 is chosen from the group consisting of:
a) the amino acid sequences of SEQ ID NO's: 401-675;
b) amino acid sequences that have at least 80% amino acid identity with at least one of the amino acid sequences of SEQ ID NO's: 401-675;
c) amino acid sequences that have 3, 2, or 1 amino acid difference with at least one of the amino acid sequences of SEQ ID NO's: 401-675;
and/or
CDR2 is chosen from the group consisting of:
d) the amino acid sequences of SEQ ID NO's: 951-1225;
e) amino acid sequences that have at least 80% amino acid identity with at least one of the amino acid sequences of SEQ ID NO's: 951-1225;
f) amino acid sequences that have 3, 2, or 1 amino acid difference with at least one of the amino acid sequences of SEQ ID NO's: 951-1225;
and/or
CDR3 is chosen from the group consisting of:
g) the amino acid sequences of SEQ ID NO's: 1501-1775;
h) amino acid sequences that have at least 80% amino acid identity with at least one of the amino acid sequences of SEQ ID NO's: 1501-1775;
i) amino acid sequences that have 3, 2, or 1 amino acid difference with at least one of the amino acid sequences of SEQ ID NO's: 1501-1775.

In particular, such an amino acid sequence of the invention may be such that CDR1 is chosen from the group consisting of the amino acid sequences of SEQ ID NO's: 401-675; and/or CDR2 is chosen from the group consisting of the amino acid sequences of SEQ ID NO's: 951-1225; and/or CDR3 is chosen from the group consisting of the amino acid sequences of SEQ ID NO's: 1501-1775.

In particular, when the amino acid sequence of the invention essentially consists of 4 framework regions (FR1 to FR4, respectively) and 3 complementarity determining regions (CDR1 to CDR3, respectively), the amino acid sequence of the invention is preferably such that:

CDR1 is chosen from the group consisting of:
a) the amino acid sequences of SEQ ID NO's: 401-675;
b) amino acid sequences that have at least 80% amino acid identity with at least one of the amino acid sequences of SEQ ID NO's: 401-675;
c) amino acid sequences that have 3, 2, or 1 amino acid difference with at least one of the amino acid sequences of SEQ ID NO's: 401-675;
and
CDR2 is chosen from the group consisting of:
d) the amino acid sequences of SEQ ID NO's: 951-1225;
e) amino acid sequences that have at least 80% amino acid identity with at least one of the amino acid sequences of SEQ ID NO's: 951-1225;
f) amino acid sequences that have 3, 2, or 1 amino acid difference with at least one of the amino acid sequences of SEQ ID NO's: 951-1225;
and
CDR3 is chosen from the group consisting of:
g) the amino acid sequences of SEQ ID NO's: 1501-1775;
h) amino acid sequences that have at least 80% amino acid identity with at least one of the amino acid sequences of SEQ ID NO's: 1501-1775;
i) amino acid sequences that have 3, 2, or 1 amino acid difference with at least one of the amino acid sequences of SEQ ID NO's: 1501-1775; or any suitable fragment of such an amino acid sequence.

In particular, such an amino acid sequence of the invention may be such that CDR1 is chosen from the group consisting of the amino acid sequences of SEQ ID NO's: 401-675 and CDR2 is chosen from the group consisting of the amino acid sequences of SEQ ID NO's: 951-1225; and CDR3 is chosen from the group consisting of the amino acid sequences of SEQ ID NO's: 1501-1775.

Again, preferred combinations of CDR sequences will become clear from the further description herein.

Also, such amino acid sequences are preferably such that they can specifically bind (as defined herein) to HER2; and more in particular bind to HER2 with an affinity (suitably measured and/or expressed as a $K_D$-value (actual or apparent), a $K_A$-value (actual or apparent), a $k_{on}$-rate and/or a $k_{off}$-rate, or alternatively as an $IC_{50}$ value, as further described herein) that is as defined herein.

In one preferred, but non-limiting aspect, the invention relates to an amino acid sequence that essentially consists of 4 framework regions (FR1 to FR4, respectively) and 3 complementarity determining regions (CDR1 to CDR3, respectively), in which the CDR sequences of said amino acid sequence have at least 70% amino acid identity, preferably at least 80% amino acid identity, more preferably at least 90% amino acid identity, such as 95% amino acid identity or more or even essentially 100% amino acid identity with the CDR sequences of at least one of the amino acid sequences of SEQ ID NO's: 2051-2325. This degree of amino acid identity can for example be determined by determining the degree of amino acid identity (in a manner described herein) between said amino acid sequence and one or more of the sequences of SEQ ID NO's: 2051-2325, in which the amino acid residues that form the framework regions are disregarded. Such amino acid sequences of the invention can be as further described herein.

In such an amino acid sequence of the invention, the framework sequences may be any suitable framework sequences, and examples of suitable framework sequences will be clear to the skilled person, for example on the basis the standard handbooks and the further disclosure and prior art mentioned herein.

The framework sequences are preferably (a suitable combination of) immunoglobulin framework sequences or framework sequences that have been derived from immunoglobulin framework sequences (for example, by humanization or camelization). For example, the framework sequences may be framework sequences derived from a light chain variable domain (e.g. a $V_L$-sequence) and/or from a heavy chain variable domain (e.g. a $V_H$-sequence). In one particularly preferred aspect, the framework sequences are either framework sequences that have been derived from a $V_{HH}$-sequence (in which said framework sequences may optionally have been partially or fully humanized) or are conventional $V_H$ sequences that have been camelized (as defined herein).

The framework sequences are preferably such that the amino acid sequence of the invention is a domain antibody (or an amino acid sequence that is suitable for use as a domain antibody); is a single domain antibody (or an amino acid sequence that is suitable for use as a single domain antibody); is a "dAb" (or an amino acid sequence that is suitable for use as a dAb); or is a Nanobody® (including but not limited to $V_{HH}$ sequence). Again, suitable framework sequences will be clear to the skilled person, for example on the basis the standard handbooks and the further disclosure and prior art mentioned herein.

In particular, the framework sequences present in the amino acid sequences of the invention may contain one or more of Hallmark residues (as defined herein), such that the amino acid sequence of the invention is a Nanobody®. Some preferred, but non-limiting examples of (suitable combinations of) such framework sequences will become clear from the further disclosure herein.

Again, as generally described herein for the amino acid sequences of the invention, it is also possible to use suitable fragments (or combinations of fragments) of any of the foregoing, such as fragments that contain one or more CDR sequences, suitably flanked by and/or linked via one or more framework sequences (for example, in the same order as these CDR's and framework sequences may occur in the full-sized immunoglobulin sequence from which the fragment has been derived). Such fragments may also again be such that they comprise or can form an immunoglobulin fold, or alternatively be such that they do not comprise or cannot form an immunoglobulin fold.

In one specific aspect, such a fragment comprises a single CDR sequence as described herein (and in particular a CDR3 sequence), that is flanked on each side by (part of) a framework sequence (and in particular, part of the framework sequence(s) that, in the immunoglobulin sequence from which the fragment is derived, are adjacent to said CDR sequence. For example, a CDR3 sequence may be preceded by (part of) a FR3 sequence and followed by (part of) a FR4 sequence). Such a fragment may also contain a disulphide bridge, and in particular a disulphide bridge that links the two framework regions that precede and follow the CDR sequence, respectively (for the purpose of forming such a disulphide bridge, cysteine residues that naturally occur in said framework regions may be used, or alternatively cysteine residues may be synthetically added to or introduced into said framework regions). For a further description of these "Expedite fragments", reference is again made to WO 03/050531, as well as to WO 08/068,280 of Ablynx N.V.

In another aspect, the invention relates to a compound or construct, and in particular a protein or polypeptide (also referred to herein as a "compound of the invention" or "polypeptide of the invention", respectively) that comprises or essentially consists of one or more amino acid sequences of the invention (or suitable fragments thereof), and optionally further comprises one or more other groups, residues, moieties or binding units. As will become clear to the skilled person from the further disclosure herein, such further groups, residues, moieties, binding units or amino acid sequences may or may not provide further functionality to the amino acid sequence of the invention (and/or to the compound or construct in which it is present) and may or may not modify the properties of the amino acid sequence of the invention.

For example, such further groups, residues, moieties or binding units may be one or more additional amino acid sequences, such that the compound or construct is a (fusion) protein or (fusion) polypeptide. In a preferred but non-limiting aspect, said one or more other groups, residues, moieties or binding units are immunoglobulin sequences. Even more preferably, said one or more other groups, residues, moieties or binding units are chosen from the group consisting of domain antibodies, amino acid sequences that are suitable for use as a domain antibody, single domain antibodies, amino acid sequences that are suitable for use as a single domain antibody, "dAb"'s, amino acid sequences that are suitable for use as a dAb, or Nanobodies.

Alternatively, such groups, residues, moieties or binding units may for example be chemical groups, residues, moieties, which may or may not by themselves be biologically and/or pharmacologically active. For example, and without limitation, such groups may be linked to the one or more amino acid sequences of the invention so as to provide a "derivative" of an amino acid sequence or polypeptide of the invention, as further described herein.

Also within the scope of the present invention are compounds or constructs, that comprises or essentially consists of one or more derivatives as described herein, and optionally further comprises one or more other groups, residues, moieties or binding units, optionally linked via one or more linkers. Preferably, said one or more other groups, residues, moieties or binding units are amino acid sequences.

In the compounds or constructs described above, the one or more amino acid sequences of the invention and the one or more groups, residues, moieties or binding units may be linked directly to each other and/or via one or more suitable linkers or spacers. For example, when the one or more groups, residues, moieties or binding units are amino acid sequences, the linkers may also be amino acid sequences, so that the resulting compound or construct is a fusion (protein) or fusion (polypeptide).

The compounds or polypeptides of the invention can generally be prepared by a method which comprises at least one step of suitably linking the one or more amino acid sequences of the invention to the one or more further groups, residues, moieties or binding units, optionally via the one or more suitable linkers, so as to provide the compound or polypeptide of the invention. Polypeptides of the invention can also be prepared by a method which generally comprises at least the steps of providing a nucleic acid that encodes a polypeptide of the invention, expressing said nucleic acid in a suitable manner, and recovering the expressed polypeptide of the invention. Such methods can be performed in a manner known per se, which will be clear to the skilled person, for example on the basis of the methods and techniques further described herein.

The process of designing/selecting and/or preparing a compound or polypeptide of the invention, starting from an amino acid sequence of the invention, is also referred to herein as "formatting" said amino acid sequence of the invention; and an amino acid of the invention that is made part of a compound or polypeptide of the invention is said to be "formatted" or to be "in the format of" said compound or polypeptide of the invention. Examples of ways in which an amino acid sequence of the invention can be formatted and examples of such formats will be clear to the skilled person based on the disclosure herein; and such formatted amino acid sequences form a further aspect of the invention.

In one specific aspect of the invention, a compound of the invention or a polypeptide of the invention may have an increased half-life, compared to the corresponding amino acid sequence of the invention. Some preferred, but non-limiting examples of such compounds and polypeptides will become clear to the skilled person based on the further disclosure herein, and for example comprise amino acid sequences or polypeptides of the invention that have been chemically modified to increase the half-life thereof (for example, by means of pegylation); amino acid sequences of the invention that comprise at least one additional binding site for binding to a serum protein (such as serum albumin; see for example EP 0 368 684 B1, page 4); or polypeptides of the invention that comprise at least one amino acid sequence of the invention that is linked to at least one moiety (and in particular at least one amino acid sequence) that increases the half-life of the amino acid sequence of the invention. Examples of polypeptides of the invention that comprise such half-life extending moieties or amino acid sequences will become clear to the skilled person based on the further disclosure herein; and for example include, without limitation, polypeptides in which the one or more amino acid sequences of the invention are suitable linked to one or more serum proteins or fragments thereof (such as (human) serum albumin or suitable fragments thereof) or to one or more binding units that can bind to serum proteins (such as, for example, domain antibodies, amino acid sequences that are suitable for use as a domain antibody, single domain antibodies, amino acid sequences that are suitable for use as a single domain antibody, "dAb"'s, amino acid sequences that are suitable for use as a dAb, or Nanobodies that can bind to serum proteins such as serum albumin (such as human serum albumin), serum immunoglobulins such as IgG, or transferrine; reference is made to the further description and references mentioned herein); polypeptides in which an amino acid sequence of the invention is linked to an Fc portion (such as a human Fc) or a suitable part or fragment thereof; or polypeptides in which the one or more amino acid sequences of the invention are suitable linked to one or more small, proteins or peptides that can bind to serum proteins (such as, without limitation, the proteins and peptides described in WO 91/01743, WO 01/45746, WO 02/076489 and to WO 08/068,280 of Ablynx N.V.

Generally, the compounds or polypeptides of the invention with increased half-life preferably have a half-life that is at least 1.5 times, preferably at least 2 times, such as at least 5 times, for example at least 10 times or more than 20 times, greater than the half-life of the corresponding amino acid sequence of the invention per se. For example, the compounds or polypeptides of the invention with increased half-life may have a half-life that is increased with more than 1 hours, preferably more than 2 hours, more preferably more than 6 hours, such as more than 12 hours, or even more than 24, 48 or 72 hours, compared to the corresponding amino acid sequence of the invention per se.

In a preferred, but non-limiting aspect of the invention, such compounds or polypeptides of the invention have a serum half-life that is increased with more than 1 hours, preferably more than 2 hours, more preferably more than 6 hours, such as more than 12 hours, or even more than 24, 48 or 72 hours, compared to the corresponding amino acid sequence of the invention per se.

In another preferred, but non-limiting aspect of the invention, such compounds or polypeptides of the invention exhibit a serum half-life in human of at least about 12 hours, preferably at least 24 hours, more preferably at least 48 hours, even more preferably at least 72 hours or more. For example, compounds or polypeptides of the invention may have a half-life of at least 5 days (such as about 5 to 10 days), preferably at least 9 days (such as about 9 to 14 days), more preferably at least about 10 days (such as about 10 to 15 days), or at least about 11 days (such as about 11 to 16 days), more preferably at least about 12 days (such as about 12 to 18 days or more), or more than 14 days (such as about 14 to 19 days).

In another aspect, the invention relates to a nucleic acid that encodes an amino acid sequence of the invention or a polypeptide of the invention (or a suitable fragment thereat).

Such a nucleic acid will also be referred to herein as a "nucleic acid of the invention" and may for example be in the form of a genetic construct, as further described herein.

In another aspect, the invention relates to a host or host cell that expresses (or that under suitable circumstances is capable of expressing) an amino acid sequence of the invention and/or a polypeptide of the invention; and/or that contains a nucleic acid of the invention. Some preferred but non-limiting examples of such hosts or host cells will become clear from the further description herein.

The invention further relates to a product or composition containing or comprising at least one amino acid sequence of the invention, at least one polypeptide of the invention (or a suitable fragment thereof) and/or at least one nucleic acid of the invention, and optionally one or more further components of such compositions known per se, i.e. depending on the intended use of the composition. Such a product or composition may for example be a pharmaceutical composition (as described herein), a veterinary composition or a product or composition for diagnostic use (as also described herein). Some preferred but non-limiting examples of such products or compositions will become clear from the further description herein.

The invention also relates to the use of an amino acid sequence, Nanobody or polypeptide of the invention, or of a composition comprising the same, in (methods or compositions for) modulating HER2, either in vitro (e.g. in an in vitro or cellular assay) or in vivo (e.g. in an a single cell or in a multicellular organism, and in particular in a mammal, and more in particular in a human being, such as in a human being that is at risk of or suffers from a cancer and/or tumor); and/or in methods for killing a tumor cell or inhibiting or preventing proliferation of a tumour cell (either in vitro or in vivo) by suitably contacting said tumor cell with an amino acid sequence, Nanobody or polypeptide of the invention, or of a composition comprising the same. In a preferred, but non-limiting aspect, a biparatopic (or multiparatopic) polypeptide of the invention is used, and more preferably one of the preferred biparatopic (or multiparatopic) polypeptides of the invention, as further described herein.

The invention also relates to methods for modulating HER2, either in vitro (e.g. in an in vitro or cellular assay) or in vivo (e.g. in an a single cell or multicellular organism, and in particular in a mammal, and more in particular in a human being, such as in a human being that is at risk of or suffers from a cancer and/or tumor), which method comprises at least the step of contacting HER2 with at least one amino acid sequence, Nanobody or polypeptide of the invention, or with a composition comprising the same, in a manner and in an amount suitable to modulate HER2, with at least one amino acid sequence, Nanobody or polypeptide of the invention. In a preferred, but non-limiting aspect, a biparatopic (or multiparatopic) polypeptide of the invention is used, and more preferably one of the preferred biparatopic (or multiparatopic) polypeptides of the invention, as further described herein.

The invention also relates to the use of an amino acid sequence, Nanobody or polypeptide of the invention in the preparation of a composition (such as, without limitation, a pharmaceutical composition or preparation as further described herein) for modulating HER2, either in vitro (e.g. in an in vitro or cellular assay) or in vivo (e.g. in an a single cell or multicellular organism, and in particular in a mammal, and more in particular in a human being, such as in a human being that is at risk of or suffers from a cancer and/or tumor). In a preferred, but non-limiting aspect, a biparatopic (or multiparatopic) polypeptide of the invention is used, and more preferably one of the preferred biparatopic (or multiparatopic) polypeptides of the invention, as further described herein.

In the context of the present invention, "modulating" or "to modulate" generally means either reducing or inhibiting the activity of, or alternatively increasing the activity of, HER2, as measured using a suitable in vitro, cellular or in vivo assay (such as those mentioned herein). In particular, "modulating" or "to modulate" may mean either reducing or inhibiting the activity of, or alternatively increasing the activity of HER2, as measured using a suitable in vitro, cellular or in vivo assay (such as those mentioned herein), by at least 1%, preferably at least 5%, such as at least 10% or at least 25%, for example by at least 50%, at least 60%, at least 70%, at least 80%, or 90% or more, compared to activity of HER2 in the same assay under the same conditions but without the presence of the amino acid sequence, Nanobody or polypeptide of the invention.

As will be clear to the skilled person, "modulating" may also involve effecting a change (which may either be an increase or a decrease) in the sensitivity of HER2 for one or more conditions in the medium or surroundings in which HER2 is present (such as pH, ion strength, the presence of co-factors, etc.), compared to the same conditions but without the presence of the amino acid sequence, Nanobody or polypeptide of the invention. As will be clear to the skilled person, this may again be determined in any suitable manner and/or using any suitable assay known per se, such as the assays described herein or in the prior art cited herein.

"Modulating" may also mean effecting a change (i.e. an activity as an agonist or as an antagonist, respectively) with respect to one or more biological or physiological mechanisms, effects, responses, functions, pathways or activities in which HER2 (or in which its substrate(s), ligand(s) or pathway(s) are involved, such as its signalling pathway or metabolic pathway and their associated biological or physiological effects) is involved. Again, as will be clear to the skilled person, such an action as an agonist or an antagonist may be determined in any suitable manner and/or using any suitable (in vitro and usually cellular or in assay) assay known per se, such as the assays described herein or in the prior art cited herein. In particular, an action as an agonist or antagonist may be such that an intended biological or physiological activity is increased or decreased, respectively, by at least 1%, preferably at least 5%, such as at least 10% or at least 25%, for example by at least 50%, at least 60%, at least 70%, at least 80%, or 90% or more, compared to the biological or physiological activity in the same assay under the same conditions but without the presence of the amino acid sequence, Nanobody or polypeptide of the invention.

Modulating may also involve activating HER2 or the mechanism or pathway in which it is involved. Modulating may be reversible or irreversible, but for pharmaceutical and pharmacological purposes will usually be in a reversible manner. Modulating may for example also involve reducing or inhibiting the binding of HER2 to another ERBB receptor (also referred to as heterodimerization) and/or competing with another ERBB receptor for binding to HER2.

Without being limiting, in one aspect, the amino acid sequence, Nanobody or polypeptide of the invention or the composition comprising the same will inhibit and/or block binding of Herceptin® to HER2. The amino acid sequence, Nanobody or polypeptide of the invention or the composition comprising the same will preferably inhibit binding of Herceptin® to HER2 by at least 1%, preferably at least 5%, such as at least 10%, for example 25% or more or even 50% or more and up to 75% or even more than 90% or more, compared to binding of Herceptin® to HER2 in the absence of the amino acid sequence, Nanobody or polypeptide of the invention or the composition comprising the same.

In another aspect, the amino acid sequence, Nanobody or polypeptide of the invention or the composition comprising the same will inhibit and/or block binding of Omnitarg to HER2. The amino acid sequence, Nanobody or polypeptide of the invention or the composition comprising the same will preferably inhibit binding of Omnitarg to HER2 by at least 1%, preferably at least 5%, such as at least 10%, for example 25% or more or even 50% or more and up to 75% or even more than 90% or more, compared to binding of Omnitarg to HER2 in the absence of the amino acid sequence, Nanobody or polypeptide of the invention or the composition comprising the same.

In another aspect, the amino acid sequence, Nanobody or polypeptide of the invention or the composition comprising the same will inhibit and/or block binding of Herceptin® and Omnitarg to HER, preferably essentially simultaneously. The amino acid sequence, Nanobody or polypeptide of the invention or the composition comprising the same will preferably inhibit binding of Herceptin® to HER2 by at least 1%, preferably at least 5%, such as at least 10%, for example 25% or more or even 50% or more and up to 75% or even more than 90% or more, compared to binding of Herceptin® to HER2 in the absence of the amino acid sequence, Nanobody or polypeptide of the invention or the composition comprising the same; and the amino acid sequence, Nanobody or polypeptide of the invention or the composition comprising the same will preferably inhibit binding of Omnitarg to HER2 by at least 1%, preferably at least 5%, such as at least 10%, for example 25% or more or even 50% or more and up to 75% or even more than 90% or more, compared to binding of Omnitarg to HER2 in the absence of the amino acid sequence, Nanobody or polypeptide of the invention or the composition comprising the same.

In another aspect, which is for example preferred for use in the prevention and treatment of tumors and cancer, the amino acid sequence, Nanobody or polypeptide of the invention or the composition comprising the same is an antagonist of HER2 and/or of the signalling that is mediated by HER-2 and/or by the ligand(s) of HER-2 (i.e. of the signalling that is caused by binding of growth factors of the EGF family to HER-2) and will inhibit and/or block such signalling (i.e. by at least 1%, preferably at least 5%, such as at least 10%, for example 25% or more or even 50% or more and up to 75% or even more than 90% or more, compared to the signalling without the presence of the amino acid sequence, Nanobody or polypeptide of the invention or the composition comprising the same, as determined in a suitable assay); and/or will inhibit or block tumor (e.g. SKBR3) cell proliferation. The amino acid sequence, Nanobody or polypeptide of the invention or the composition comprising the same will preferably inhibit tumor (e.g. SKBR3) cell proliferation by at least 1%, preferably at least 5%, such as at least 10%, for example 25% or more or even 50% or more and up to 75% or even more than 90% or more, compared to the tumor (e.g. SKBR3) cell proliferation in the absence of the amino acid sequence, Nanobody or polypeptide of the invention or the composition comprising the same. In a preferred aspect, the amino acid sequence, Nanobody or polypeptide of the invention or the composition comprising the same will inhibit and/or block tumor (e.g. SKBR3) cell proliferation equally or better than Herceptin®. In another preferred aspect, the amino acid sequence, Nanobody or polypeptide of the invention or the composition comprising the same will inhibit and/or block tumor (e.g. SKBR3) cell proliferation equally or better than Omnitarg. In another preferred aspect, the amino acid sequence, Nanobody or polypeptide of the invention or the composition comprising the same will inhibit and/or block tumor (e.g. SKBR3) cell proliferation equally or better than Herceptin® and Omnitarg. In a preferred, but non-limiting aspect, a suitable antagonistic biparatopic (or multiparatopic) polypeptide of the invention is used, and more preferably one of the preferred biparatopic (or multiparatopic) polypeptides of the invention, as further described herein.

In another aspect, which is for example preferred for use in the prevention and treatment of diseases and disorders that can be prevented or treated by increasing HER-2 signalling in one or more cells or tissues of a patient to be treated, such as certain cardiac disorders (i.e. those characterised by reduced HER-2-mediated signalling or those that are a side-effect from treating a patient with a HER-2 antagonist), the amino acid sequence, Nanobody or polypeptide of the invention or the composition comprising the same is an agonist of HER2 and will induce cell proliferation. The amino acid sequence, Nanobody or polypeptide of the invention or the composition comprising the same will preferably increase the signalling that is mediated by HER-2 and/or by the ligand(s) of HER-2 (i.e. by at least 1%, preferably at least 5%, such as at least 10%, for example 25% or more or even 50% or more and up to 75% or even more than 90% or more, compared to the signalling without the presence of the amino acid sequence, Nanobody or polypeptide of the invention or the composition comprising the same, as determined in a suitable assay); and/or will induce cell proliferation by at least 1%, preferably at least 5%, such as at least 10%, for example 25% or more or even 50% or more and up to 75% or even more than 90% or more, compared to the cell proliferation in the absence of the amino acid sequence, Nanobody or polypeptide of the invention or the composition comprising the same. In a preferred, but non-limiting aspect, a suitable agonistic biparatopic (or multiparatopic) polypeptide of the invention is used, and more preferably one of the preferred biparatopic (or multiparatopic) polypeptides of the invention, as further described herein.

In another aspect, which is for example preferred for use in the prevention and treatment of tumors and cancer, the amino acid sequence, Nanobody or polypeptide of the invention or the composition comprising the same is an antagonist of HER2 and will inhibit, downregulate and/or block cell signalling. The amino acid sequence, Nanobody or polypeptide of the invention or the composition comprising the same will preferably inhibit and/or downregulate cell signalling by at least 1%, preferably at least 5%, such as at least 10%, for example 25% or more or even 50% or more and up to 75% or even more than 90% or more, compared to the cell signalling in the absence of the amino acid sequence, Nanobody or polypeptide of the invention or the composition comprising the same. In a preferred aspect, the amino acid sequence, Nanobody or polypeptide of the invention or the composition comprising the same will inhibit, downregulate and/or block cell signalling equally or better than Herceptin®. In another preferred aspect, the amino acid sequence, Nanobody or polypeptide of the invention or the composition comprising the same will inhibit, downregulate and/or block cell signalling equally or better than Omnitarg. In another preferred aspect, the amino acid sequence, Nanobody or polypeptide of the invention or the composition comprising the same will inhibit, downregulate and/or block cell signalling equally or better than Herceptin® and Omnitarg. In a preferred, but non-limiting aspect, a suitable antagonistic biparatopic (or multiparatopic) polypeptide of the invention is used, and more preferably one of the preferred biparatopic (or multiparatopic) polypeptides of the invention, as further described herein.

In another aspect, which is for example preferred for use in the prevention and treatment of diseases and disorders that can be prevented or treated by increasing HER-2 signalling in one or more cells or tissues of a patient to be treated, such as certain cardiac disorders (i.e. those characterised by reduced HER-2-mediated signalling or those that are a side-effect from treating a patient with a HER-2 antagonist), the amino acid sequence, Nanobody or polypeptide of the invention or the composition comprising the same is an agonist of HER2 and will induce cell signalling. The amino acid sequence, Nanobody or polypeptide of the invention or the composition comprising the same will preferably induce cell signalling by at least 1%, preferably at least 5%, such as at least 10%, for example 25% or more or even 50% or more and up to 75% or even more than 90% or more, compared to the cell signalling in the absence of the amino acid sequence, Nanobody or polypeptide of the invention or the composition comprising the same. In a preferred, but non-limiting aspect, a suitable agonistic biparatopic (or multiparatopic) polypeptide of the invention is used, and more preferably one of the preferred biparatopic (or multiparatopic) polypeptides of the invention, as further described herein.

In another aspect, which is for example preferred for use in the prevention and treatment of tumors and cancer, the amino acid sequence, Nanobody or polypeptide of the invention or the composition comprising the same is an antagonist of HER2 and will inhibit and/or block tumor (e.g. SKBR3) cell proliferation in vivo. The amino acid sequence, Nanobody or polypeptide of the invention or the composition comprising the same will preferably inhibit tumor (e.g. SKBR3) cell proliferation in vivo by at least 1%, preferably at least 5%, such as at least 10%, for example 25% or more or even 50% or more and up to 75% or even more than 90% or more, compared to the tumor (e.g. SKBR3) cell proliferation in vivo in the absence of the amino acid sequence, Nanobody or polypeptide of the invention or the composition comprising the same. In a preferred aspect, the amino acid sequence, Nanobody or polypeptide of the invention or the composition comprising the same will inhibit and/or block tumor (e.g. SKBR3) cell proliferation in vivo equally or better than Herceptin®. In another preferred aspect, the amino acid sequence, Nanobody or polypeptide of the invention or the composition comprising the same will inhibit and/or block tumor (e.g. SKBR3) cell proliferation in vivo equally or better than Omnitarg. In another preferred aspect, the amino acid sequence, Nanobody or polypeptide of the invention or the composition comprising the same will inhibit and/or block tumor (e.g. SKBR3) cell proliferation in vivo equally or better than Herceptin® and Omnitarg. In a preferred, but non-limiting aspect, a suitable antagonistic biparatopic (or multiparatopic) polypeptide of the invention is used, and more preferably one of the preferred biparatopic (or multiparatopic) polypeptides of the invention, as further described herein.

In another aspect, which is for example preferred for use in the prevention and treatment of tumors and cancer, the amino acid sequence, Nanobody or polypeptide of the invention or the composition comprising the same is an antagonist of HER2 and will inhibit, downregulate and/or block ligand-mediated ErbB signalling. The amino acid sequence, Nanobody or polypeptide of the invention or the composition comprising the same will preferably inhibit and/or downregulate ligand-mediated ErbB signalling by at least 1%, preferably at least 5%, such as at least 10%, for example 25% or more or even 50% or more and up to 75% or even more than 90% or more, compared to the ligand-mediated ErbB signalling in the absence of the amino acid sequence, Nanobody or polypeptide of the invention or the composition comprising the same. In a preferred aspect, the amino acid sequence, Nanobody or polypeptide of the invention or the composition comprising the same will inhibit and/or block ligand-mediated ErbB signalling equally or better than Herceptin®. In another preferred aspect, the amino acid sequence, Nanobody or polypeptide of the invention or the composition comprising the same will inhibit and/or block ligand-mediated ErbB signalling equally or better than Omnitarg. In another preferred aspect, the amino acid sequence, Nanobody or polypeptide of the invention or the composition comprising the same will inhibit and/or block ligand-mediated ErbB signalling equally or better than Herceptin® and Omnitarg. In a preferred, but non-limiting aspect, a suitable antagonistic biparatopic (or multiparatopic) polypeptide of the invention is used, and more preferably one of the preferred biparatopic (or multiparatopic) polypeptides of the invention, as further described herein.

In another aspect, which is for example preferred for use in the prevention and treatment of tumors and cancer, the amino acid sequence, Nanobody or polypeptide of the invention or the composition comprising the same is an antagonist of HER2 and will inhibit and/or block HER2 ectodomain cleavage. The amino acid sequence, Nanobody or polypeptide of the invention or the composition comprising the same will preferably inhibit HER2 ectodomain cleavage by at least 1%, preferably at least 5%, such as at least 10%, for example 25% or more or even 50% or more and up to 75% or even more than 90% or more, compared to the HER2 ectodomain cleavage in the absence of the amino acid sequence, Nanobody or polypeptide of the invention or the composition comprising the same. In a preferred aspect, the amino acid sequence, Nanobody or polypeptide of the invention or the composition comprising the same will inhibit and/or block HER2 ectodomain cleavage equally or better than Herceptin®. In another preferred aspect, the amino acid sequence, Nanobody or polypeptide of the invention or the composition comprising the same will inhibit and/or block HER2 ectodomain cleavage equally or better than Omnitarg. In another preferred aspect, the amino acid sequence, Nanobody or polypeptide of the invention or the composition comprising the same will inhibit and/or block HER2 ectodomain cleavage equally or better than Herceptin® and Omnitarg. In a preferred, but non-limiting aspect, a suitable antagonistic biparatopic (or multiparatopic) polypeptide of the invention is used, and more preferably one of the preferred biparatopic (or multiparatopic) polypeptides of the invention, as further described herein.

In another aspect, which is for example preferred for use in the prevention and treatment of tumors and cancer, the amino acid sequence, Nanobody or polypeptide of the invention or the composition comprising the same is an antagonist of HER2 and will inhibit and/or block Heregulin-mediated activation of MAPK/Erk1/2. The amino acid sequence, Nanobody or polypeptide of the invention or the composition comprising the same will preferably inhibit Heregulin-mediated activation of MAPK/Erk1/2 by at least 1%, preferably at least 5%, such as at least 10%, for example 25% or more or even 50% or more and up to 75% or even more than 90% or more, compared to the Heregulin-mediated activation of MAPK/Erk1/2 in the absence of the amino acid sequence, Nanobody or polypeptide of the invention or the composition comprising the same. In a preferred aspect, the amino acid sequence, Nanobody or polypeptide of the invention or the composition comprising the same will inhibit and/or block Heregulin-mediated activation of MAPK/Erk1/2 equally or better than Herceptin®. In another preferred aspect, the amino acid sequence, Nanobody or polypeptide of the invention or the composition comprising the same will inhibit and/or block Heregulin-mediated activation of MAPK/Erk1/2 equally or better than Omnitarg. In another preferred aspect, the amino acid sequence, Nanobody or polypeptide of the invention or the composition comprising the same will inhibit and/or block Heregulin-mediated activation of MAPK/Erk1/2 equally or better than Herceptin® and Omnitarg. In a preferred, but non-limiting aspect, a suitable antagonistic biparatopic (or multiparatopic) polypeptide of the invention is used, and more preferably one of the preferred biparatopic (or multiparatopic) polypeptides of the invention, as further described herein.

In another aspect, which is for example preferred for use in the prevention and treatment of tumors and cancer, the amino acid sequence, Nanobody or polypeptide of the invention or the composition comprising the same is an antagonist of HER2 and will inhibit and/or block PI3K/Akt signalling. The amino acid sequence, Nanobody or polypeptide of the invention or the composition comprising the same will preferably inhibit PI3K/Akt signalling by at least 1%, preferably at least 5%, such as at least 10%, for example 25% or more or even 50% or more and up to 75% or even more than 90% or more, compared to the PI3K/Akt signalling in the absence of the amino acid sequence, Nanobody or polypeptide of the invention or the composition comprising the same. In a preferred aspect, the amino acid sequence, Nanobody or polypeptide of the invention or the composition comprising the same will inhibit and/or block PI3K/Akt signalling equally or better than Herceptin®. In another preferred aspect, the amino acid sequence, Nanobody or polypeptide of the invention or the composition comprising the same will inhibit and/or block. PI3K/Akt signalling equally or better than Omnitarg. In another preferred aspect, the amino acid sequence, Nanobody or polypeptide of the invention or the composition comprising the same will inhibit and/or block PI3K/Akt signalling equally or better than Herceptin® and Omnitarg. In a preferred, but non-limiting aspect, a suitable antagonistic biparatopic (or multiparatopic) polypeptide of the invention is used, and more preferably one of the preferred biparatopic (or multiparatopic) polypeptides of the invention, as further described herein.

In another aspect, which is for example preferred for use in the prevention and treatment of tumors and cancer, the amino acid sequence, Nanobody or polypeptide of the invention or the composition comprising the same is an antagonist of HER2 and will inhibit, downregulate and/or block cell signalling in vivo. The amino acid sequence, Nanobody or polypeptide of the invention or the composition comprising the same will preferably inhibit and/or downregulate cell signalling in vivo by at least 1%, preferably at least 5%, such as at least 10%, for example 25% or more or even 50% or more and up to 75% or even more than 90% or more, compared to the cell signalling in vivo in the absence of the amino acid sequence, Nanobody or polypeptide of the invention or the composition comprising the same. In a preferred aspect, the amino acid sequence, Nanobody or polypeptide of the invention or the composition comprising the same will inhibit and/or block cell signalling in vivo equally or better than Herceptin®. In another preferred aspect, the amino acid sequence, Nanobody or polypeptide of the invention or the composition comprising the same will inhibit and/or block cell signalling in vivo equally or better than Omnitarg. In another preferred aspect, the amino acid sequence, Nanobody or polypeptide of the invention or the composition comprising the same will inhibit and/or block cell signalling in vivo equally or better than Herceptin® and Omnitarg. In a preferred, but non-limiting aspect, a suitable antagonistic biparatopic (or multiparatopic) polypeptide of the invention is used, and more preferably one of the preferred biparatopic (or multiparatopic) polypeptides of the invention, as further described herein.

In another aspect, which is for example preferred for use in the prevention and treatment of tumors and cancer, the amino acid sequence, Nanobody or polypeptide of the invention or the composition comprising the same will induce apoptosis in tumor cells. The amino acid sequence, Nanobody or polypeptide of the invention or the composition comprising the same will preferably induce apoptosis in tumor cells by at least 1%, preferably at least 5%, such as at least 10%, for example 25% or more or even 50% or more and up to 75% or even more than 90% or more, compared to apoptosis in tumor cells in the absence of the amino acid sequence, Nanobody or polypeptide of the invention or the composition comprising the same. In a preferred aspect, the amino acid sequence, Nanobody or polypeptide of the invention or the composition comprising the same will induce apoptosis in tumor cells equally or better than Herceptin®. In another preferred aspect, the amino acid sequence, Nanobody or polypeptide of the invention or the composition comprising the same will induce apoptosis in tumor cells equally or better than Omnitarg. In another preferred aspect, the amino acid sequence, Nanobody or polypeptide of the invention or the composition comprising the same will induce apoptosis in tumor cells equally or better than Herceptin® and Omnitarg. In a preferred, but non-limiting aspect, a suitable antagonistic biparatopic (or multiparatopic) polypeptide of the invention is used, and more preferably one of the preferred biparatopic (or multiparatopic) polypeptides of the invention, as further described herein.

In another aspect, which is for example preferred for use in the prevention and treatment of tumors and cancer, the amino acid sequence, Nanobody or polypeptide of the invention or the composition comprising the same will inhibit and/or block heterodimerization between ERBB receptors. The amino acid sequence, Nanobody or polypeptide of the invention or the composition comprising the same will preferably inhibit and/or block heterodimerization between ERBB receptors by at least 1%, preferably at least 5%, such as at least 10%, for example 25% or more or even 50% or more and up to 75% or even more than 90% or more, compared to the heterodimerization between ERBB receptors in the absence of the amino acid sequence, Nanobody or polypeptide of the invention or the composition comprising the same. In a preferred aspect, the amino acid sequence. Nanobody or polypeptide of the invention or the composition comprising the same will inhibit and/or block heterodimerization between ERBB receptors equally or better than Omnitarg. In a preferred, but non-limiting aspect, a suitable antagonistic biparatopic (or multiparatopic) polypeptide of the invention is used, and more preferably one of the preferred biparatopic (or multiparatopic) polypeptides of the invention, as further described herein.

In another aspect, which is for example preferred for use in the prevention and treatment of tumors and cancer, the amino acid sequence, Nanobody or polypeptide of the invention or the composition comprising the same will inhibit and/or block tumor vascularisation. The amino acid sequence, Nanobody or polypeptide of the invention or the composition comprising the same will preferably inhibit tumor vascularisation by at least 1%, preferably at least 5%, such as at least 10%, for example 25% or more or even 50% or more and up to 75% or even more than 90% or more, compared to the tumor vascularisation in the absence of the amino acid sequence, Nanobody or polypeptide of the invention or the composition comprising the same. In a preferred aspect, the amino acid sequence, Nanobody or polypeptide of the invention or the composition comprising the same will inhibit and/or block tumor vascularisation equally or better than Herceptin®. In another preferred aspect, the amino acid sequence, Nanobody or polypeptide of the invention or the composition comprising the same will inhibit and/or block tumor vascularisation equally or better than Omnitarg. In another preferred aspect, the amino acid sequence, Nanobody or polypeptide of the invention or the composition comprising the same will inhibit and/or block tumor vascularisation equally or better than Herceptin® and Omnitarg. In a preferred, but non-limiting aspect, a suitable antagonistic biparatopic (or multiparatopic) polypeptide of the invention is used, and more preferably one of the preferred biparatopic (or multiparatopic) polypeptides of the invention, as further described herein.

In another aspect, which is for example preferred for use in the prevention and treatment of tumors and cancer, the amino acid sequence, Nanobody or polypeptide of the invention or the composition comprising the same will inhibit and/or block TNF induced signalling and/or cell proliferation. The amino acid sequence, Nanobody or polypeptide of the invention or the composition comprising the same will preferably inhibit TNF induced signalling and/or cell proliferation by at least 1%, preferably at least 5%, such as at least 10%, for example 25% or more or even 50% or more and up to 75% or even more than 90% or more, compared to the TNF induced signalling and/or cell proliferation in the absence of the amino acid sequence, Nanobody or polypeptide of the invention or the composition comprising the same. In a preferred aspect, the amino acid sequence, Nanobody or polypeptide of the invention or the composition comprising the same will inhibit and/or block TNF induced signalling and/or cell proliferation equally or better than Herceptin®. In another preferred aspect, the amino acid sequence, Nanobody or polypeptide of the invention or the composition comprising the same will inhibit and/or block TNF induced signalling and/or cell proliferation equally or better than Omnitarg. In another preferred aspect, the amino acid sequence, Nanobody or polypeptide of the invention or the composition comprising the same will inhibit and/or block TNF induced signalling and/or cell proliferation equally or better than Herceptin® and Omnitarg. In a preferred, but non-limiting aspect, a suitable antagonistic biparatopic (or multiparatopic) polypeptide of the invention is used, and more preferably one of the preferred biparatopic (or multiparatopic) polypeptides of the invention, as further described herein.

In another aspect, which is for example preferred for use in the prevention and treatment of tumors and cancer, the amino acid sequence, Nanobody or polypeptide of the invention or the composition comprising the same will downregulate HER2 levels. The amino acid sequence, Nanobody or polypeptide of the invention or the composition comprising the same will preferably will downregulate HER2 levels by at least 1%, preferably at least 5%, such as at least 10%, for example 25% or more or even 50% or more and up to 75% or even more than 90% or more, compared to the HER2 levels in the absence of the amino acid sequence, Nanobody or polypeptide of the invention or the composition comprising the same. In a preferred aspect, the amino acid sequence, Nanobody or polypeptide of the invention or the composition comprising the same will down-regulate HER2 levels equally or better than Herceptin®. In another preferred aspect, the amino acid sequence, Nanobody or polypeptide of the invention or the composition comprising the same will downregulate HER2 levels equally or better than Omnitarg. In another preferred aspect, the amino acid sequence, Nanobody or polypeptide of the invention or the composition comprising the same will downregulate HER2 levels equally or better than Herceptin® and Omnitarg. In a preferred, but non-limiting aspect, a suitable antagonistic biparatopic (or multiparatopic) polypeptide of the invention is used, and more preferably one of the preferred biparatopic (or multiparatopic) polypeptides of the invention, as further described herein.

In another aspect, which is for example preferred for use in the prevention and treatment of tumors and cancer, the amino acid sequence, Nanobody or polypeptide of the invention or the composition comprising the same will inhibit and/or block metalloproteinase-mediated HER2 ectodomain shedding. The amino acid sequence, Nanobody or polypeptide of the invention or the composition comprising the same will preferably inhibit metalloproteinase-mediated HER2 ectodomain shedding by at least 1%, preferably at least 5%, such as at least 10%, for example 25% or more or even 50% or more and up to 75% or even more than 90% or more, compared to the metalloproteinase-mediated HER2 ectodomain shedding in the absence of the amino acid sequence, Nanobody or polypeptide of the invention or the composition comprising the same. In a preferred aspect, the amino acid sequence, Nanobody or polypeptide of the invention or the composition comprising the same will inhibit and/or block metalloproteinase-mediated HER2 ectodomain shedding equally or better than Herceptin®. In another preferred aspect, the amino acid sequence, Nanobody or polypeptide of the invention or the composition comprising the same will inhibit and/or block metalloproteinase-mediated HER2 ectodomain shedding equally or better than Omnitarg. In another preferred aspect, the amino acid sequence, Nanobody or polypeptide of the invention or the composition comprising the same will inhibit and/or block metalloproteinase-mediated HER2 ectodomain shedding equally or better than Herceptin® and Omnitarg. In a preferred, but non-limiting aspect, a suitable antagonistic biparatopic (or multiparatopic) polypeptide of the invention is used, and more preferably one of the preferred biparatopic (or multiparatopic) polypeptides of the invention, as further described herein.

The amino acid sequence, Nanobody or polypeptide of the invention or the composition comprising the same should at least "modulate" or effect a change (i.e. an activity as an agonist or as an antagonist, respectively) with respect to at least one biological or physiological mechanisms, effects, responses, functions, pathways or activities (also referred to herein as "having at least one mode of action") in which HER2 (or in which its pathway(s) are involved, such as its signalling pathway or metabolic pathway and their associated biological or physiological effects) is involved. In one aspect, the amino acid sequence, Nanobody or polypeptide of the invention or the composition comprising the same may "modulate" or effect a change with respect to more than one (such as two, three, four or even more) biological or physiological mechanisms, effects, responses, functions, pathways or activities (i.e. the amino acid sequence, Nanobody or polypeptide of the invention or the composition comprising the same may have more than one mode of action). In this respect, the present inventors surprisingly found that the biparatopic amino acid sequence, Nanobody or polypeptide of the invention or the composition comprising the same could combine two different modes of action (such as e.g. they could inhibit and/or block two different cell signalling pathways; they could e.g. inhibit and/or block heterodimerization between ERBB receptors and at the same time downregulate HER2 levels).

The different modes of action are mediated each by one of the binding units (as further defined herein) of the biparatopic amino acid sequence, Nanobody or polypeptide of the invention, wherein each binding unit binds at a different binding site of HER2. In a preferred aspect, the biparatopic amino acid sequence, Nanobody or polypeptide of the invention combine the modes of action of Herceptin® and Omnitarg.

Accordingly, the present invention also relates to a biparatopic amino acid sequence, Nanobody or polypeptide of the invention or a composition comprising the same that combines two different modes of action each mediated by one of the binding units of the biparatopic amino acid sequence, Nanobody or polypeptide of the invention, wherein each binding unit binds at a different binding site of HER2.

Accordingly, the present invention also relates to a triparatopic amino acid sequence, Nanobody or polypeptide of the invention or a composition comprising the same that combines two or three different modes of action each mediated by one of the binding units of the triparatopic amino acid sequence, Nanobody or polypeptide of the invention, wherein each binding unit binds at a different binding site of HER2.

More generally, the present invention relates to a multiparatopic amino acid sequence, Nanobody or polypeptide of the invention or a composition comprising the same that combines two or more different modes of action each mediated by one of the binding units of the multiparatopic amino acid sequence, Nanobody or polypeptide of the invention, wherein each binding unit binds at a different binding site of HER2.

The invention further relates to methods for preparing or generating the amino acid sequences, polypeptides, nucleic acids, host cells, products and compositions described herein. Some preferred but non-limiting examples of such methods will become clear from the further description herein.

Generally, these methods may comprise the steps of:
a) providing a set, collection or library of amino acid sequences; and
b) screening said set, collection or library of amino acid sequences for amino acid sequences that can bind to and/or have affinity for HER2;
and
c) isolating the amino acid sequence(s) that can bind to and/or have affinity for HER2.

In such a method, the set, collection or library of amino acid sequences may be any suitable set, collection or library of amino acid sequences. For example, the set, collection or library of amino acid sequences may be a set, collection or library of immunoglobulin sequences (as described herein), such as a naïve set, collection or library of immunoglobulin sequences; a synthetic or semi-synthetic set, collection or library of immunoglobulin sequences; and/or a set, collection or library of immunoglobulin sequences that have been subjected to affinity maturation.

Also, in such a method, the set, collection or library of amino acid sequences may be a set, collection or library of heavy chain variable domains (such as $V_H$ domains or $V_{HH}$ domains) or of light chain variable domains. For example, the set, collection or library of amino acid sequences may be a set, collection or library of domain antibodies or single domain antibodies, or may be a set, collection or library of amino acid sequences that are capable of functioning as a domain antibody or single domain antibody.

In a preferred aspect of this method, the set, collection or library of amino acid sequences may be an immune set, collection or library of immunoglobulin sequences, for example derived from a mammal that has been suitably immunized with HER2 or with a suitable antigenic determinant based thereon or derived therefrom, such as an antigenic part, fragment, region, domain, loop or other epitope thereof. In one particular aspect, said antigenic determinant may be an extracellular part, region, domain, loop or other extracellular epitope(s).

In the above methods, the set, collection or library of amino acid sequences may be displayed on a phage, phagemid, ribosome or suitable micro-organism (such as yeast), such as to facilitate screening. Suitable methods, techniques and host organisms for displaying and screening (a set, collection or library of) amino acid sequences will be clear to the person skilled in the art, for example on the basis of the further disclosure herein. Reference is also made to the review by Hoogenboom in Nature Biotechnology, 23, 9, 1105-1116 (2005).

In the above step b), the set, collection or library may for example be screened for (nucleic acid sequences that encode) amino acid sequences that can bind to the Herceptin® binding site on HER-2 (and may in particular to domain IV of HER2, more in particular to the C-terminus of domain IV of HER2) and/or that compete with Herceptin® for binding to HER-2.

Alternatively, in the above step b), the set, collection or library may for example be screened for (nucleic acid sequences that encode) amino acid sequences that can bind to the Omnitarg binding site on HER-2 (and may in particular to domain II of HER2, more in particular to the middle of domain II of HER2) and/or that compete with Omnitarg for binding to HER-2.

In the above methods, screening or selecting for (nucleic acid sequences that encode) amino acid sequences that compete with Herceptin® or Omnitarg, respectively, may be performed using generally known methods for screening or selecting for competitors of known binding molecules, which may for example involve performing the screening or selection in the presence of the binding molecule and/or determining the binding affinity of the compound(s) to be screened in the presence of the binding molecule.

In another aspect, the method for generating amino acid sequences comprises at least the steps of:
a) providing a collection or sample of cells expressing amino acid sequences;
b) screening said collection or sample of cells for cells that express an amino acid sequence that can bind to and/or have affinity for HER2;
and
c) either (i) isolating said amino acid sequence; or (ii) isolating from said cell a nucleic acid sequence that encodes said amino acid sequence, followed by expressing said amino acid sequence.

For example, when the desired amino acid sequence is an immunoglobulin sequence, the collection or sample of cells may for example be a collection or sample of B-cells. Also, in this method, the sample of cells may be derived from a mammal that has been suitably immunized with HER2 or with a suitable antigenic determinant based thereon or derived therefrom, such as an antigenic part, fragment, region, domain, loop or other epitope thereof. In one particular aspect, said antigenic determinant may be an extracellular part, region, domain, loop or other extracellular epitope(s).

The above method may be performed in any suitable manner, as will be clear to the skilled person. Reference is for example made to EP 0 542 810, WO 05/19824, WO 04/051268 and WO 04/106377. The screening of step b) is preferably performed using a flow cytometry technique such as FACS. For this, reference is for example made to Lieby et al., Blood, Vol. 97, No. 12, 3820 (2001).

Again, in the above step b), the set, collection or library may for example be screened for (nucleic acid sequences that encode) amino acid sequences that can bind to the Herceptin® binding site on HER-2 (and may in particular to domain IV of HER2, more in particular to the C-terminus of domain IV of HER2) and/or that compete with Herceptin® for binding to HER-2; or alternatively for (nucleic acid sequences that encode) amino acid sequences that can bind to the Omnitarg binding site on HER-2 (and may in particular to domain II of HER2, more in particular to the middle of domain II of HER2) and/or that compete with Omnitarg for binding to HER-2.

In another aspect, the method for generating an amino acid sequence directed against HER2 may comprise at least the steps of
a) providing a set, collection or library of nucleic acid sequences encoding amino acid sequences;
b) screening said set, collection or library of nucleic acid sequences for nucleic acid sequences that encode an amino acid sequence that can bind to and/or has affinity for HER2; and
c) isolating said nucleic acid sequence, followed by expressing said amino acid sequence.

In such a method, the set, collection or library of nucleic acid sequences encoding amino acid sequences may for example be a set, collection or library of nucleic acid sequences encoding a naïve set, collection or library of immunoglobulin sequences; a set, collection or library of nucleic acid sequences encoding a synthetic or semi-synthetic set, collection or library of immunoglobulin sequences; and/or a set, collection or library of nucleic acid sequences encoding a set, collection or library of immunoglobulin sequences that have been subjected to affinity maturation.

Also, in such a method, the set, collection or library of nucleic acid sequences may encode a set, collection or library of heavy chain variable domains (such as $V_H$ domains or $V_{HH}$ domains) or of light chain variable domains. For example, the set, collection or library of nucleic acid sequences may encode a set, collection or library of domain antibodies or single domain antibodies, or a set, collection or library of amino acid sequences that are capable of functioning as a domain antibody or single domain antibody.

In a preferred aspect of this method, the set, collection or library of nucleic acid sequences may be an immune set, collection or library of nucleic acid sequences, for example derived from a mammal that has been suitably immunized with HER2 or with a suitable antigenic determinant based thereon or derived therefrom, such as an antigenic part, fragment, region, domain, loop or other epitope thereof. In one particular aspect, said antigenic determinant may be an extracellular part, region, domain, loop or other extracellular epitope(s).

The set, collection or library of nucleic acid sequences may for example encode an immune set, collection or library of heavy chain variable domains or of light chain variable domains. In one specific aspect, the set, collection or library of nucleotide sequences may encode a set, collection or library of $V_{HH}$ sequences.

In the above methods, the set, collection or library of nucleotide sequences may be displayed on a phage, phagemid, ribosome or suitable micro-organism (such as yeast), such as to facilitate screening. Suitable methods, techniques and host organisms for displaying and screening (a set, collection or library of) nucleotide sequences encoding amino acid sequences will be clear to the person skilled in the art, for example on the basis of the further disclosure herein. Reference is also made to the review by Hoogenboom in Nature Biotechnology, 23, 9, 1105-1116 (2005).

Again, in the above step b), the set, collection or library may for example be screened for (nucleic acid sequences that encode) amino acid sequences that can bind to the Herceptin® binding site on HER-2 (and may in particular to domain IV of HER2, more in particular to the C-terminus of domain IV of HER2) and/or that compete with Herceptin® for binding to HER-2; or alternatively for (nucleic acid sequences that encode) amino acid sequences that can bind to the Omnitarg binding site on HER-2 (and may in particular to domain II of HER2, more in particular to the middle of domain II of HER2) and/or that compete with Omnitarg for binding to HER-2.

In another aspect, the method for generating an amino acid sequence directed against HER2 may comprise at least the steps of:
a) providing a set, collection or library of nucleic acid sequences encoding amino acid sequences;
b) screening said set, collection or library of nucleic acid sequences for nucleic acid sequences that encode an amino acid sequence that can bind to and/or has affinity for HER2 and that is cross-blocked or is cross blocking a Nanobody of the invention, e.g. SEQ ID NO: 2051-2325, or a polypeptide or construct of the invention, e.g. SEQ ID NO: 2326-2390; and
c) isolating said nucleic acid sequence, followed by expressing said amino acid sequence.

In such a method, the set, collection or library of nucleic acid sequences encoding amino acid sequences may for example be a set, collection or library of nucleic acid sequences encoding a naïve set, collection or library of immunoglobulin sequences; a set, collection or library of nucleic acid sequences encoding a synthetic or semi-synthetic set, collection or library of immunoglobulin sequences; and/or a set, collection or library of nucleic acid sequences encoding a set, collection or library of immunoglobulin sequences that have been subjected to affinity maturation.

Also, in such a method, the set, collection or library of nucleic acid sequences may encode a set, collection or library of heavy chain variable domains (such as $V_H$ domains or $V_{HH}$ domains) or of light chain variable domains. For example, the set, collection or library of nucleic acid sequences may encode a set, collection or library of domain antibodies or single domain antibodies, or a set, collection or library of amino acid sequences that are capable of functioning as a domain antibody or single domain antibody.

In a preferred aspect of this method, the set, collection or library of nucleic acid sequences may be an immune set, collection or library of nucleic acid sequences, for example derived from a mammal that has been suitably immunized with HER2 or with a suitable antigenic determinant based thereon or derived therefrom, such as an antigenic part, fragment, region, domain, loop or other epitope thereof. In one particular aspect, said antigenic determinant may be an extracellular part, region, domain, loop or other extracellular epitope(s).

The set, collection or library of nucleic acid sequences may for example encode an immune set, collection or library of heavy chain variable domains or of light chain variable domains. In one specific aspect, the set, collection or library of nucleotide sequences may encode a set, collection or library of $V_{HH}$ sequences.

In the above methods, the nucleic acid sequence encoding an HER2 binding amino acid sequence fused to the set, collection or library of nucleotide sequences may be displayed on a phage, phagemid, ribosome or suitable micro-organism (such as yeast), such as to facilitate screening. Suitable methods, techniques and host organisms for displaying and screening (a set, collection or library of) nucleotide sequences encoding amino acid sequences will be clear to the person skilled in the art, for example on the basis of the further disclosure herein. Reference is also made to the review by Hoogenboom in. Nature Biotechnology, 23, 9, 1105-1116 (2005).

Also encompassed within the present invention are methods for preparing and generating multiparatopic (such as e.g. biparatopic, triparatopic, etc.) amino acids of the invention.

Without being limiting, a method for preparing and generating biparatopic amino acids of the invention may comprise at least the steps of:

a) providing a nucleic acid sequence encoding an HER2 binding amino acid sequence fused to a set, collection or library of nucleic acid sequences encoding amino acid sequences;

b) screening said set, collection or library of nucleic acid sequences for nucleic acid sequences that encode an amino acid sequence that can bind to and/or has affinity for an antigenic determinant on HER2 different from the antigenic determinant recognized by the HER2 binding amino acid sequence;

and c) isolating the nucleic acid sequence encoding an HER2 binding amino acid sequence fused to the nucleic acid sequence obtained in b), followed by expressing the encoded amino acid sequence.

The biparatopic amino acid sequence obtained in the method above, can subsequently be fused to one or more further sets, collections or libraries of nucleic acid sequences encoding amino acid sequences and again screened for nucleic acid sequences that encode an amino acid sequence that can bind to and/or has affinity for an antigenic determinant on HER2 different from the antigenic determinant of the HER2 binding amino acid sequence and the antigenic determinant of b) in order to obtain a triparatopic or multiparatopic amino acid sequence respectively.

in such a method, the set, collection or library of nucleic acid sequences encoding amino acid sequences may for example be a set, collection or library of nucleic acid sequences encoding a naïve set, collection or library of immunoglobulin sequences; a set, collection or library of nucleic acid sequences encoding a synthetic or semi-synthetic set, collection or library of immunoglobulin sequences; and/or a set, collection or library of nucleic acid sequences encoding a set, collection or library of immunoglobulin sequences that have been subjected to affinity maturation.

Also, in such a method, the set, collection or library of nucleic acid sequences may encode a set, collection or library of heavy chain variable domains (such as $V_H$ domains or $V_{HH}$ domains) or of light chain variable domains. For example, the set, collection or library of nucleic acid sequences may encode a set, collection or library of domain antibodies or single domain antibodies, or a set, collection or library of amino acid sequences that are capable of functioning as a domain antibody or single domain antibody.

In a preferred aspect of this method, the set, collection or library of nucleic acid sequences may be an immune set, collection or library of nucleic acid sequences, for example derived from a mammal that has been suitably immunized with HER2 or with a suitable antigenic determinant based thereon or derived therefrom, such as an antigenic part, fragment, region, domain, loop or other epitope thereof. In one particular aspect, said antigenic determinant may be an extracellular part, region, domain, loop or other extracellular epitope(s).

The set, collection or library of nucleic acid sequences may for example encode an immune set, collection or library of heavy chain variable domains or of light chain variable domains. In one specific aspect, the set, collection or library of nucleotide sequences may encode a set, collection or library of $V_{HH}$ sequences.

In the above methods, the nucleic acid sequence encoding an HER2 binding amino acid sequence fused to the set, collection or library of nucleotide sequences may be displayed on a phage, phagemid, ribosome or suitable micro-organism (such as yeast), such as to facilitate screening. Suitable methods, techniques and host organisms for displaying and screening (a set, collection or library of) nucleotide sequences encoding amino acid sequences will be clear to the person skilled in the art, for example on the basis of the further disclosure herein. Reference is also made to the review by Hoogenboom in Nature Biotechnology, 23, 9, 1105-1116 (2005).

According to a particularly preferred aspect, a method for preparing and generating biparatopic amino acids of the invention may comprise at least the steps of:

a) providing a set, collection or library of nucleic acid sequences, in which each nucleic acid sequence in said set, collection or library encodes a fusion protein that comprises a first amino acid sequence that can bind to and/or has affinity for a first antigenic determinant, part, domain or epitope on HER2 that is fused (optionally via a linker sequence) to a second amino acid sequence, in which essentially each second amino acid sequence (or most of these) is a different member of a set, collection or library of different amino acid sequences;

b) screening said set, collection or library of nucleic acid sequences for nucleic acid sequences that encode an amino acid sequence that can bind to and/or has affinity for a second antigenic determinant, part, domain or epitope on HER2 different from the first antigenic determinant, part, domain or epitope on HER-2;

and c) isolating the nucleic acid sequences that encode an amino acid sequence that can bind to and/or has affinity for a second antigenic determinant, part, domain or epitope on HER2 different from the first antigenic determinant, part, domain or epitope on HER-2, obtained in b), optionally followed by expressing the encoded amino acid sequence.

In this preferred method, the first amino acid sequence in the fusion protein encoded by said set collection or library of nucleic acid sequences may be the same amino acid sequence for all members of the set, collection or library of nucleic acid sequences encoding the fusion protein; or the first amino acid sequence in the fusion protein encoded by said set collection or library of nucleic acid sequences may also be a member of a set collection or library of different amino acid sequences.

Again, in such a method, the set, collection or library of nucleic acid sequences encoding amino acid sequences that form part of the fusion protein may for example be a set, collection or library of nucleic acid sequences encoding a naïve set, collection or library of immunoglobulin sequences; a set, collection or library of nucleic acid sequences encoding a synthetic or semi-synthetic set, collection or library of immunoglobulin sequences; and/or a set, collection or library of nucleic acid sequences encoding a set, collection or library of immunoglobulin sequences that have been subjected to affinity maturation.

Also, in such a method, the set, collection or library of nucleic acid sequences may encode a set, collection or library of heavy chain variable domains (such as $V_H$ domains or $V_{HH}$ domains) or of light chain variable domains. For example, the set, collection or library of nucleic acid sequences may encode a set, collection or library of domain antibodies or single domain antibodies, or a set, collection or library of amino acid sequences that are capable of functioning as a domain antibody or single domain antibody.

In a preferred aspect of this method, the set, collection or library of nucleic acid sequences may be an immune set, collection or library of nucleic acid sequences, for example derived from a mammal that has been suitably immunized with HER2 or with a suitable antigenic determinant based thereon or derived therefrom, such as an antigenic part, fragment, region, domain, loop or other epitope thereof. In one particular aspect, said antigenic determinant may be an extracellular part, region, domain, loop or other extracellular epitope(s).

The set, collection or library of nucleic acid sequences may for example encode an immune set, collection or library of heavy chain variable domains or of light chain variable domains. In one specific aspect, the set, collection or library of nucleotide sequences may encode a set, collection or library of $V_{HH}$ sequences.

In the above methods, the nucleic acid sequence encoding an HER2 binding amino acid sequence fused to the set, collection or library of nucleotide sequences may be displayed on a phage, phagemid, ribosome or suitable micro-organism (such as yeast), such as to facilitate screening. Suitable methods, techniques and host organisms for displaying and screening (a set, collection or library of) nucleotide sequences encoding amino acid sequences will be clear to the person skilled in the art, for example on the basis of the further disclosure herein. Reference is also made to the review by Hoogenboom in Nature Biotechnology, 23, 9, 11.05-1116 (2005).

In step b), the set, collection or library of nucleic acid sequences may also be screened for nucleic acid sequences that encode an amino acid sequence that can bind to and/or has affinity for both the first antigenic determinant, part, domain or epitope on HER2 and the second antigenic determinant, part, domain or epitope on HER2. This may for example be performed in a subsequent steps (i.e. by in a first step screening or selecting for nucleic acid sequences that encode an amino acid sequence that can bind to and/or has affinity for the second antigenic determinant, part, domain or epitope on HER2, and subsequently in a second step selecting or screening for nucleic acid sequences that encode an amino acid sequence that can bind to and/or has affinity for the first antigenic determinant, part, domain or epitope on HER2; or visa versa) or in a single step (i.e. by simultaneously screening or selecting for nucleic acid sequences that encode an amino acid sequence that can bind to and/or has affinity for both the first antigenic determinant, part, domain or epitope on HER2 and the second antigenic determinant, part, domain or epitope on HER2).

In a preferred aspect of the above method, the first amino acid sequence used in step a) is preferably such that (i) it can bind to and/or has affinity for the Herceptin® binding site on HER2 (and may in particular be directed against domain IV of HER2, more in particular the C-terminus of domain IV of HER2) and/or (ii) competes with Herceptin® for binding to HER-2; and in step b), the set, collection or library of nucleic acid sequences is screened for nucleic acid sequences that encode (i) an amino acid sequence that can bind to and/or has affinity for the Omnitarg binding site on HER2 (and may in particular domain II of HER2, more in particular the middle of domain II of HER2) and/or (ii) an amino acid sequence that can compete with Omnitarg (or the Omnitarg Fab used in Example 9) for binding to HER-2.

Alternatively, the first amino acid sequence used in step a) is preferably such that (i) it can bind to and/or has affinity for the Omnitarg binding site on HER2 (and may in particular domain IT of HER2, more in particular the middle of domain II of HER2) and/or (ii) competes with Omnitarg for binding to HER-2; and in step b), the set, collection or library of nucleic acid sequences is screened for nucleic acid sequences that encode (i) an amino acid sequence that can bind to and/or has affinity for the Herceptin® binding site on HER2 (and in particular domain IV of HER2, more in particular the C-terminus of domain IV of HER2) and/or (ii) an amino acid sequence that can compete with Herceptin® for binding to HER-2.

In the above methods, screening or selecting for (nucleic acid sequences that encode) amino acid sequences that compete with Herceptin® or Omnitarg, respectively, may be performed using generally known methods for screening or selecting for competitors of known binding molecules, which may for example involve performing the screening or selection in the presence of the binding molecule and/or determining the binding affinity of the compound(s) to be screened in the presence of the binding molecule.

It is also possible, in step b), to screen for nucleic acid sequences that both (i) encode an amino acid sequence that can bind to and/or has affinity for the Omnitarg binding site on HER2 (and in particular domain II of HER2, more in particular the middle of domain II of HER2) and/or that can compete with Omnitarg (or the Omnitarg Fab used in Example 9) for binding to HER-2; and that also (ii) encode an amino acid sequence that can bind to and/or has affinity for the Herceptin® binding site on HER2 (and in particular domain IV of HER2, more in particular the C-terminus of domain IV of HER2) and/or that can compete with Herceptin® for binding to HER-2. Again, this may be performed in separate steps or a single step, and by selecting or screening in the presence of Herceptin® and/or Omnitarg, as applicable.

It will also be clear to the skilled person that the above methods may be performed by screening a set, collection or library of amino acid sequences that correspond to (e.g. are encoded by) the nucleic acid sequences used in the above method; and such methods form further aspects of the invention.

The invention in a further aspect provides a method for preparing and generating biparatopic amino acids of the invention which comprises at least the steps of:

a) providing a set, collection or library of nucleic acid sequences, in which each nucleic acid sequence in said set, collection or library encodes a fusion protein that comprises a first amino acid sequence that can bind to and/or has affinity for a first antigenic determinant, part, domain or epitope on HER2 that is fused via a linker sequence to a second amino acid sequence that can bind to and/or has affinity for a second antigenic determinant, part, domain or epitope on HER2 (which may be the same or different as the first antigenic determinant, part, domain or epitope on HER2), in which essentially each nucleic acid sequence (or most of these) encodes a fusion protein with a different linker sequence so as to provide a set, collection or library of nucleic acid sequences encoding different fusion proteins;

b) screening said set, collection or library of nucleic acid sequences for nucleic acid sequences that encode an amino acid sequence that can bind to and/or has affinity for the first and second antigenic determinant, part, domain or epitope on HER2;
and c) isolating the nucleic acid sequences that encode an amino acid sequence that can bind to and/or has affinity for the first and second antigenic determinant, part, domain or epitope on HER2, optionally followed by expressing the encoded amino acid sequence.

As will be clear to the skilled person, this method can be used to screen for suitable or even optimal linker lengths for linking the first and second amino acid sequence. For example, in this aspect, the first amino acid sequence may be an amino acid sequence that can bind to and/or has affinity for the Omnitarg binding site on HER2 (and may in particular domain II of HER2, more in particular the middle of domain II of HER2) and/or that can compete with Omnitarg (or the Omnitarg Fab used in Example 9); and the second amino acid sequence may be an amino acid sequence that can bind to and/or has affinity for the Herceptin® binding site on HER2 (and in particular domain IV of HER2, more in particular the C-terminus of domain IV of HER2) and/or that can compete with Herceptin® for binding to HER-2 (or visa versa). The screening and selection step b) may be performed as further described above.

Another method for preparing and generating biparatopic amino acids of the invention may comprise at least the steps of:
a) providing a set, collection or library of nucleic acid sequences encoding amino acid sequences;
b) screening said set, collection or library of nucleic acid sequences for a set, collection or library of nucleic acid sequences that encode an amino acid sequence that can bind to and/or has affinity for HER2;
c) ligating said set, collection or library of nucleic acid sequences that encode an amino acid sequence that can bind to and/or has affinity for HER2 to another nucleic acid sequence that encodes an amino acid sequence that can bind to and/or has affinity for HER2 (e.g. a nucleic acid sequence that encodes an amino acid sequence that competes with Herceptin® for binding HER2);
and
d) from the set, collection or library of nucleic acid sequences obtained in c), isolating the nucleic acid sequences encoding a biparatopic amino acid sequence that can bind to and/or has affinity for HER2 (and e.g. further selecting for nucleic acid sequences that encode a biparatopic amino acid sequence that antagonizes with higher potency compared to the monovalent amino acid sequences), followed by expressing the encoded amino acid sequence.

The biparatopic amino acid sequence obtained in the method above, can subsequently be fused to one or more further sets, collections or libraries of nucleic acid sequences encoding amino acid sequences that can bind to and/or have affinity for HER2 in order to obtain a triparatopic or multiparatopic amino acid sequence respectively.

In such a method, the set, collection or library of nucleic acid sequences encoding amino acid sequences may for example be a set, collection or library of nucleic acid sequences encoding a naïve set, collection or library of immunoglobulin sequences; a set, collection or library of nucleic acid sequences encoding a synthetic or semi-synthetic set, collection or library of immunoglobulin sequences; and/or a set, collection or library of nucleic acid sequences encoding a set, collection or library of immunoglobulin sequences that have been subjected to affinity maturation.

The set, collection or library of nucleic acid sequences that encode an amino acid sequence that can bind to and/or has affinity for HER2 can be obtained by any selection or screening method known in the art for the selection and/or screening of nucleic acid sequences that encode an amino acid sequence that can bind to and/or has affinity for HER2 and as, for example, described in the Examples section.

Also, in such a method, the set, collection or library of nucleic acid sequences may encode a set, collection or library of heavy chain variable domains (such as $V_H$ domains or $V_{HH}$ domains) or of light chain variable domains. For example, the set, collection or library of nucleic acid sequences may encode a set, collection or library of domain antibodies or single domain antibodies, or a set, collection or library of amino acid sequences that are capable of functioning as a domain antibody or single domain antibody.

In a preferred aspect of this method, the set, collection or library of nucleic acid sequences may be an immune set, collection or library of nucleic acid sequences, for example derived from a mammal that has been suitably immunized with HER2 or with a suitable antigenic determinant based thereon or derived therefrom, such as an antigenic part, fragment, region, domain, loop or other epitope thereof. In one particular aspect, said antigenic determinant may be an extracellular part, region, domain, loop or other extracellular epitope(s).

The set, collection or library of nucleic acid sequences may for example encode an immune set, collection or library of heavy chain variable domains or of light chain variable domains. In one specific aspect, the set, collection or library of nucleotide sequences may encode a set, collection or library of $V_{HH}$ sequences.

In the above methods, the nucleic acid sequence may be displayed on a phage, phagemid, ribosome or suitable microorganism (such as yeast), such as to facilitate screening. Suitable methods, techniques and host organisms for displaying and screening (a set, collection or library of) nucleotide sequences encoding amino acid sequences will be clear to the person skilled in the art, for example on the basis of the further disclosure herein. Reference is also made to the review by Hoogenboom in Nature Biotechnology, 23, 9, 1105-1116 (2005).

Another method for preparing and generating biparatopic amino acids of the invention may comprise at least the steps of:
a) providing a first set, collection or library of nucleic acid sequences encoding amino acid sequences;
b) screening said first set, collection or library of nucleic acid sequences for a nucleic acid sequence that encodes an amino acid sequence that can bind to and/or has affinity for a first antigenic determinant, part, domain or epitope on HER2;
c) ligating the nucleic acid sequence encoding said amino acid sequence that can bind to and/or has affinity for a first antigenic determinant, part, domain or epitope on HER2 obtained in b) to another set, collection or library of nucleic acid sequences encoding amino acid sequences to obtain a set, collection or library of nucleic acid sequences that encode fusion proteins;
d) screening said set, collection or library of nucleic acid sequences obtained in step c) for a nucleic acid sequence that encodes an amino acid sequence that can bind a second antigenic determinant, part, domain or epitope on HER2 different from the first antigenic determinant, part, domain or epitope on HER-2;
and
e) isolating the nucleic acid sequence that encodes an amino acid sequence that can bind to and/or has affinity for the first and second antigenic determinant, part, domain or epitope on HER2, optionally followed by expressing the encoded amino acid sequence.

In a preferred aspect of the above method, the first amino acid sequence obtained in step b) is preferably such that (i) it can bind to and/or has affinity for the Herceptin® binding site on HER2 (and may in particular be directed against domain IV of HER2, more in particular the C-terminus of domain IV of HER2) and/or (ii) competes with Herceptin® for binding to HER-2; and in step d), the set, collection or library of nucleic acid sequences is screened for nucleic acid sequences that encode (i) an amino acid sequence that can bind to and/or has affinity for the Omnitarg binding site on HER2 (and may in particular domain II of HER2, more in particular the middle of domain II of HER2) and/or (ii) an amino acid sequence that can compete with Omnitarg (or the Omnitarg Fab used in Example 9) for binding to HER-2.

Alternatively, the first amino acid sequence obtained in step b) is preferably such that (i) it can bind to and/or has affinity for the Omnitarg binding site on HER2 (and may in particular domain II of HER2, more in particular the middle of domain II of HER2) and/or (ii) competes with Omnitarg for binding to HER-2; and in step d), the set, collection or library of nucleic acid sequences is screened for nucleic acid sequences that encode (i) an amino acid sequence that can bind to and/or has affinity for the Herceptin® binding site on HER2 (and in particular domain IV of HER2, more in particular the C-terminus of domain IV of HER2) and/or (ii) an amino acid sequence that can compete with Herceptin® for binding to HER-2.

In the above methods, screening or selecting for (nucleic acid sequences that encode) amino acid sequences that compete with Herceptin® or Omnitarg, respectively, may be performed using generally known methods for screening or selecting for competitors of known binding molecules, which may for example involve performing the screening or selection in the presence of the binding molecule and/or determining the binding affinity of the compound(s) to be screened in the presence of the binding molecule.

It is also possible, in step d), to screen for nucleic acid sequences that both (i) encode an amino acid sequence that can bind to and/or has affinity for the Omnitarg binding site on HER2 (and in particular domain II of HER2, more in particular the middle of domain II of HER2) and/or that can compete with Omnitarg (or the Omnitarg Fab used in Example 9) for binding to HER-2; and that also (ii) encode an amino acid sequence that can bind to and/or has affinity for the Herceptin® binding site on HER2 (and in particular domain IV of HER2, more in particular the C-terminus of domain IV of HER2) and/or that can compete with Herceptin® for binding to HER-2. Again, this may be performed in separate steps or a single step, and by selecting or screening in the presence of Herceptin® and/or Omnitarg, as applicable.

The biparatopic amino acid sequence obtained in the method above, can subsequently be fused to one or more further sets, collections or libraries of nucleic acid sequences encoding amino acid sequences that can bind to and/or have affinity for HER2 in order to obtain a triparatopic or multiparatopic amino acid sequence respectively. In such a method, the set, collection or library of nucleic acid sequences encoding amino acid sequences may for example be a set, collection or library of nucleic acid sequences encoding a naïve set, collection or library of immunoglobulin sequences; a set, collection or library of nucleic acid sequences encoding a synthetic or semi-synthetic set, collection or library of immunoglobulin sequences; and/or a set, collection or library of nucleic acid sequences encoding a set, collection or library of immunoglobulin sequences that have been subjected to affinity maturation.

The set, collection or library of nucleic acid sequences that encode an amino acid sequence that can bind to and/or has affinity for HER2 can be obtained by any selection or screening method known in the art for the selection and/or screening of nucleic acid sequences that encode an amino acid sequence that can bind to and/or has affinity for HER2 and as, for example, described in the Examples section.

Also, in such a method, the set, collection or library of nucleic acid sequences may encode a set, collection or library of heavy chain variable domains (such as $V_H$ domains or $V_{HH}$ domains) or of light chain variable domains. For example, the set, collection or library of nucleic acid sequences may encode a set, collection or library of domain antibodies or single domain antibodies, or a set, collection or library of amino acid sequences that are capable of functioning as a domain antibody or single domain antibody.

In a preferred aspect of this method, the set, collection or library of nucleic acid sequences may be an immune set, collection or library of nucleic acid sequences, for example derived from a mammal that has been suitably immunized with HER2 or with a suitable antigenic determinant based thereon or derived therefrom, such as an antigenic part, fragment, region, domain, loop or other epitope thereof. In one particular aspect, said antigenic determinant may be an extracellular part, region, domain, loop or other extracellular epitope(s).

The set, collection or library of nucleic acid sequences may for example encode an immune set, collection or library of heavy chain variable domains or of light chain variable domains. In one specific aspect, the set, collection or library of nucleotide sequences may encode a set, collection or library of $V_{HH}$ sequences.

In the above methods, the nucleic acid sequence may be displayed on a phage, phagemid, ribosome or suitable microorganism (such as yeast), such as to facilitate screening. Suitable methods, techniques and host organisms for displaying and screening (a set, collection or library of) nucleotide sequences encoding amino acid sequences will be clear to the person skilled in the art, for example on the basis of the further disclosure herein. Reference is also made to the review by Hoogenboom in Nature Biotechnology, 23, 9, 1105-1116 (2005).

The invention also relates to amino acid sequences that are obtained by the above methods, or alternatively by a method that comprises one of the above methods and in addition at least the steps of determining the nucleotide sequence or amino acid sequence of said immunoglobulin sequence; and of expressing or synthesizing said amino acid sequence in a manner known per se, such as by expression in a suitable host cell or host organism or by chemical synthesis.

Another method for preparing multivalent and/or multiparatopic/biparatopic amino acids or constructs of the invention may comprise at least the steps of linking two or more monovalent amino acid sequences or monovalent construct of the invention and for example one or more linkers together in a suitable manner. The monovalent constructs (and linkers) can be coupled by any method known in the art and as further described herein. Preferred techniques include the linking of the nucleic acid sequences that encode the monovalent constructs (and linkers) to prepare a genetic construct that expresses the multivalent and/or multiparatopic/biparatopic amino acid or construct. Techniques for linking amino acid sequences or nucleic acid sequences will be clear to the skilled person, and reference is again made to the standard handbooks, such as Sambrook et al. and Ausubel et al., mentioned above, as well as the Examples below.

Accordingly, the present invention also relates to the use of a monovalent construct (which may comprise or essentially consists of an amino acid sequence of the invention such as a domain antibody, an amino acid sequence that is suitable for use as a domain antibody, a single domain antibody, an amino acid sequence that is suitable for use as a single domain antibody, a "dAb", an amino acid sequences that is suitable for use as a dAb, or a Nanobody) in providing and/or preparing a multivalent (such as multiparatopic, and preferably biparatopic) compound or construct. The monovalent construct is then used as a binding domain or binding unit in providing and/or preparing the multivalent (such as multiparatopic, and preferably biparatopic) construct comprising two (e.g. in a biparatopic construct) or more (e.g. in a multiparatopic construct) binding units. In this respect, the monovalent construct may be used as a binding domain or binding unit in providing and/or preparing a multivalent (such as multiparatopic, and preferably biparatopic) construct of the invention comprising two or more binding units.

In a preferred aspect, the monovalent construct (which may comprise or essentially consists of an amino acid sequence of the invention such as a domain antibody, an amino acid sequence that is suitable for use as a domain antibody, a single domain antibody, an amino acid sequence that is suitable for use as a single domain antibody, a "dAb", an amino acid sequences that is suitable for use as a dAb, or a Nanobody) is used in providing and/or preparing a multivalent (such as multiparatopic, and preferably biparatopic) construct that exhibits intramolecular binding compared to intermolecular binding. In such multivalent constructs of the invention that comprises amino acid sequences directed against two or more (different) antigenic determinants on the same antigen (for example against different epitopes of an antigen and/or against different subunits of a multimeric receptor or protein), the length and flexibility of the linker are preferably such that, when the multivalent construct binds to HER-2, at least two and preferably all of the amino acid sequences that are present in the multivalent construct can (simultaneously) bind to each of their intended antigenic determinants, epitopes, parts or domains, most preferably so as to allow binding with increased avidity and also intramolecular binding and/or recognition. Accordingly, the present invention also relates to the use of a monovalent construct (which may comprise or essentially consists of an amino acid sequence of the invention such as a domain antibody, an amino acid sequence that is suitable for use as a domain antibody, a single domain antibody, an amino acid sequence that is suitable for use as a single domain antibody, a "dAb", an amino acid sequences that is suitable for use as a dAb, or a Nanobody) as a binding domain or binding unit in providing and/or preparing a multivalent (such as multiparatopic, and preferably biparatopic) construct, wherein the binding domains or binding units are linked via a linker such that the multivalent (such as multiparatopic, and preferably biparatopic) construct preferably exhibits intramolecular binding compared to intermolecular binding.

In some of the most preferred multiparatopic polypeptides of the invention, (i) at least one monovalent construct of the invention (and in particular at least one Nanobody) is used that is directed against the Omnitarg binding site on HER2 (and in particular against domain II of HER2, and more in particular against the middle of domain II of HER2) and/or that is capable of competing with Omnitarg for binding to HER-2; and at least one amino acid sequence of the invention (and in particular at least one Nanobody) is used that is directed against another antigenic determinant, epitope, part or domain of HER2. In such a preferred multiparatopic construct of the invention, the linker is most preferably such that the multiparatopic construct of the invention is capable of (simultaneously) binding to both the Omnitarg binding site on HER2 (and in particular against domain II of HER2, and more in particular against the middle of domain II of HER2) as well as the other antigenic determinant, epitope, part or domain of HER2, again most preferably so as to allow binding with increased avidity and also intramolecular binding and/or recognition. Accordingly, also encompassed in the present invention is the use of a monovalent construct comprising an amino acid of the invention (and in particular a Nanobody) that is directed against the Omnitarg binding site on HER2 (and in particular against domain II of HER2, and more in particular against the middle of domain II of HER2) and/or that is capable of competing with Omnitarg for binding to HER-2, as a binding domain or binding unit in providing and/or preparing a multiparatopic (such as biparatopic) construct, wherein the binding domains or binding units are linked via a linker such that the multiparatopic (such as biparatopic) construct preferably exhibits intramolecular binding compared to intermolecular binding.

In some of the most preferred multiparatopic polypeptides of the invention, (i) at least one monovalent construct of the invention (and in particular at least one Nanobody) is used that is directed against the Herceptin® binding site on HER2 (and in particular against domain IV of HER2, and more in particular against the C-terminus of domain IV of HER2) and/or that is capable of competing with Herceptin® for binding to HER-2; and at least one amino acid of the invention (and in particular at least one Nanobody) is used that is directed against another antigenic determinant, epitope, part or domain of HER2. In such a preferred multiparatopic construct of the invention, the linker is most preferably such that the multiparatopic construct of the invention is capable of (simultaneously) binding to both the Herceptin® binding site on HER2 (and in particular against domain IV of HER2, and more in particular against the C-terminus of domain IV of HER2), as well as the other antigenic determinant, epitope, part or domain of HER2, again most preferably so as to allow binding with increased avidity and also intramolecular binding and/or recognition. Accordingly, also encompassed in the present invention is the use of a monovalent construct comprising an amino acid sequence of the invention (and in particular at least one Nanobody) that is directed against the Herceptin® binding site on HER2 (and in particular against domain IV of HER2, and more in particular against the C-terminus of domain IV of HER2) and/or that is capable of competing with Herceptin® for binding to HER-2, as a binding domain or binding unit in providing and/or preparing a multiparatopic (such as a biparatopic) construct, wherein the binding domains or binding units are linked via a linker such that the multiparatopic (such as biparatopic) construct preferably exhibits intramolecular binding compared to intermolecular binding.

In some of the most preferred multiparatopic polypeptides of the invention, (i) at least one monovalent construct of the invention (and in particular at least one Nanobody) is used that is directed against the Omnitarg binding site on HER2 (and in particular against domain II of HER2, and more in particular against the middle of domain II of HER2) and/or that is capable of competing with Omnitarg for binding to HER-2; and at least one monovalent construct of the invention (and in particular at least one Nanobody) is used that is directed against the Herceptin® binding site on HER2 (and in particular against domain IV of HER2, and more in particular against the C-terminus of domain IV of HER2) and/or that is capable of competing with Herceptin® for binding to HER-2. In such a preferred multiparatopic construct of the invention, the linker is most preferably such that the multiparatopic construct of the invention is capable of (simultaneously) binding to both the Omnitarg binding site on HER2 (and in particular against domain II of HER2, and more in particular against the middle of domain II of HER2) as well as the Herceptin® binding site on HER2 (and in particular against domain IV of HER2, and more in particular against the C-terminus of domain IV of HER2), again most preferably so as to allow binding with increased avidity and also intramolecular binding and/or recognition. Accordingly, also encompassed in the present invention is the use of a monovalent construct comprising an amino acid sequence of the invention (and in particular at least one Nanobody) that is directed against the Herceptin® binding site on HER2 (and in particular against domain IV of HER2, and more in particular against the C-terminus of domain IV of HER2) and/or that is capable of competing with Herceptin® for binding to HER-2, and a monovalent construct comprising an amino acid of the invention (and in particular a Nanobody) that is directed against the Omnitarg binding site on HER2 (and in particular against domain II of HER2, and more in particular against the middle of domain II of HER2) and/or that is capable of competing with Omnitarg for binding to HER-2, as binding domains or binding units in providing and/or preparing a multiparatopic (such as a biparatopic) construct, wherein the binding domains or binding units are linked via a linker such that the multiparatopic (such as biparatopic) construct preferably exhibits intramolecular binding compared to intermolecular binding.

The invention also relates to amino acid sequences that are obtained by the above methods, or alternatively by a method that comprises one of the above methods and in addition at least the steps of determining the nucleotide sequence or amino acid sequence of said immunoglobulin sequence; and of expressing or synthesizing said amino acid sequence in a manner known per se, such as by expression in a suitable host cell or host organism or by chemical synthesis.

In this respect, the present invention also relates to the use of a nucleic acid or nucleotide sequence that encodes a monovalent construct of the invention for the preparation of a genetic construct (as further defined herein) that encodes a multivalent (such as multiparatopic, and preferably biparatopic) construct. Also, as will be clear to the skilled person, to prepare such a genetic construct, encoding a multivalent (such as multiparatopic, and preferably biparatopic) construct of the invention, several nucleotide sequences, such as at least two nucleotide sequences encoding a monovalent construct of the invention and for example nucleic acids encoding one or more linkers can be linked together in a suitable manner. Such genetic constructs generally also comprises one or more elements of genetic constructs known per se, such as for example one or more suitable regulatory elements (such as a suitable promoter(s), enhancer(s), terminator(s), etc.) and the further elements of genetic constructs referred to herein.

Techniques for generating the nucleic acids of the invention will be clear to the skilled person and may for instance include, but are not limited to, automated DNA synthesis; site-directed mutagenesis; combining two or more naturally occurring and/or synthetic sequences (or two or more parts thereof), introduction of mutations that lead to the expression of a truncated expression product; introduction of one or more restriction sites (e.g. to create cassettes and/or regions that may easily be digested and/or ligated using suitable restriction enzymes), and/or the introduction of mutations by means of a PCR reaction using one or more "mismatched" primers. These and other techniques will be clear to the skilled person, and reference is again made to the standard handbooks, such as Sambrook et al. and Ausubel et al., mentioned above, as well as the Examples below.

Also, following the steps above, one or more amino acid sequences of the invention may be suitably humanized (or alternatively camelized); and/or the amino acid sequence(s) thus obtained may be linked to each other or to one or more other suitable amino acid sequences (optionally via one or more suitable linkers) so as to provide a polypeptide of the invention. Also, a nucleic acid sequence encoding an amino acid sequence of the invention may be suitably humanized (or alternatively camelized) and suitably expressed; and/or one or more nucleic acid sequences encoding an amino acid sequence of the invention may be linked to each other or to one or more nucleic acid sequences that encode other suitable amino acid sequences (optionally via nucleotide sequences that encode one or more suitable linkers), after which the nucleotide sequence thus obtained may be suitably expressed so as to provide a polypeptide of the invention.

The invention further relates to applications and uses of the amino acid sequences, compounds, constructs, polypeptides, nucleic acids, host cells, products and compositions described herein, as well as to methods for the prevention and/or treatment for diseases and disorders associated with HER2. Some preferred but non-limiting applications and uses will become clear from the further description herein.

The invention also relates to the amino acid sequences, compounds, constructs, polypeptides, nucleic acids, host cells, products and compositions described herein for use in therapy.

In particular, the invention also relates to the amino acid sequences, compounds, constructs, polypeptides, nucleic acids, host cells, products and compositions described herein for use in therapy of a disease or disorder that can be prevented or treated by administering, to a subject in need thereof, of (a pharmaceutically effective amount of) an amino acid sequence, compound, construct or polypeptide as described herein.

More in particular, the invention relates to the amino acid sequences, compounds, constructs, polypeptides, nucleic acids, host cells, products and compositions described herein for use in therapy of cancers and/or tumors.

Other aspects, embodiments, advantages and applications of the invention will also become clear from the further description herein, in which the invention will be described and discussed in more detail with reference to the Nanobodies of the invention and polypeptides of the invention comprising the same, which form some of the preferred aspects of the invention.

As will become clear from the further description herein, Nanobodies generally offer certain advantages (outlined herein) compared to "dAb's" or similar (single) domain antibodies or immunoglobulin sequences, which advantages are also provided by the Nanobodies of the invention. However, it will be clear to the skilled person that the more general aspects of the teaching below can also be applied (either directly or analogously) to other amino acid sequences of the invention.

DETAILED DESCRIPTION OF THE INVENTION

In the present description, examples and claims:
a) Unless indicated or defined otherwise, all terms used have their usual meaning in the art, which will be clear to the skilled person. Reference is for example made to the standard handbooks, such as Sambrook et al, "Molecular Cloning: A Laboratory Manual" (2nd. Ed.), Vols. 1-3, Cold Spring Harbor Laboratory Press (1989); F. Ausubel et al, eds., "Current protocols in molecular biology", Green Publishing and Wiley Interscience, New York (1987); Lewin, "Genes II", John Wiley & Sons, New York, N.Y., (1985); Old et al., "Principles of Gene Manipulation: An Introduction to Genetic Engineering", 2nd edition, University of California Press, Berkeley, Calif. (1981); Roitt et al., "Immunology" (6th. Ed.), Mosby/Elsevier, Edinburgh (2001); Roitt et al., Roitt's Essential Immunology, 10$^{th}$ Ed. Blackwell Publishing, UK (2001); and Janeway et al., "Immunobiology" (6th Ed.), Garland Science Publishing/ Churchill Livingstone, N.Y. (2005), as well as to the general background art cited herein;

b) Unless indicated otherwise, the term "immunoglobulin sequence"—whether used herein to refer to a heavy chain antibody or to a conventional 4-chain antibody—is used as a general term to include both the full-size antibody, the individual chains thereof, as well as all parts, domains or fragments thereof (including but not limited to antigen-binding domains or fragments such as $V_{HH}$ domains or $V_H/V_L$ domains, respectively). In addition, the term "sequence" as used herein (for example in terms like "immunoglobulin sequence", "antibody sequence", "variable domain sequence", "$V_{HH}$ sequence" or "protein sequence"), should generally be understood to include both the relevant amino acid sequence as well as nucleic acids or nucleotide sequences encoding the same, unless the context requires a more limited interpretation. Also, the term "nucleotide sequence" as used herein also encompasses a nucleic acid molecule with said nucleotide sequence, so that the terms "nucleotide sequence" and "nucleic acid" should be considered equivalent and are used interchangeably herein;

c) Unless indicated otherwise, all methods, steps, techniques and manipulations that are not specifically described in detail can be performed and have been performed in a manner known per se, as will be clear to the skilled person. Reference is for example again made to the standard handbooks and the general background art mentioned herein and to the further references cited therein; as well as to for example the following reviews Presta, Adv. Drug Deliv. Rev. 2006, 58 (5-6): 640-56; Levin and Weiss, Mol. Biosyst. 2006, 2(1): 49-57; Irving et al., J. Immunol. Methods, 2001, 248(1-2), 31-45; Schmitz et al., Placenta, 2000, 21 Suppl. A, S106-12, Gonzales et al., Tumour Biol., 2005, 26(1), 31-43, which describe techniques for protein engineering, such as affinity maturation and other techniques for improving the specificity and other desired properties of proteins such as immunoglobulins.

d) Amino acid residues will be indicated according to the standard three-letter or one-letter amino acid code, as mentioned in Table A-2;

TABLE A-2 one-letter and three-letter amino acid code

| | | | |
|---|---|---|---|
| Nonpolar, uncharged (at pH 6.0-7.0)[3] | Alanine | Ala | A |
| | Valine | Val | V |
| | Leucine | Leu | L |
| | Isoleucine | Ile | I |
| | Phenylalanine | Phe | F |
| | Methionine[1] | Met | M |
| | Tryptophan | Trp | W |
| | Proline | Pro | P |
| Polar, uncharged (at pH 6.0-7.0) | Glycine[2] | Gly | G |
| | Serine | Ser | S |
| | Threonine | Thr | T |
| | Cysteine | Cys | C |
| | Asparagine | Asn | N |
| | Glutamine | Gln | Q |
| | Tyrosine | Tyr | Y |

TABLE A-2-continued one-letter and three-letter amino acid code

| | | | |
|---|---|---|---|
| Polar, charged (at pH 6.0-7.0) | Lysine | Lys | K |
| | Arginine | Arg | R |
| | Histidine[4] | His | H |
| | Aspartate | Asp | D |
| | Glutamate | Glu | E |

Notes:
[1]Sometimes also considered to be a polar uncharged amino acid.
[2]Sometimes also considered to be a nonpolar uncharged amino acid.
[3]As will be clear to the skilled person, the fact that an amino acid residue is referred to in this Table as being either charged or uncharged at pH 6.0 to 7.0 does not reflect in any way on the charge said amino acid residue may have at a pH lower than 6.0 and/or at a pH higher than 7.0; the amino acid residues mentioned in the Table can be either charged and/or uncharged at such a higher or lower pH, as will be clear to the skilled person.
[4]As is known in the art, the charge of a His residue is greatly dependant upon even small shifts in pH, but a His residu can generally be considered essentially uncharged at a pH of about 6.5.

e) For the purposes of comparing two or more nucleotide sequences, the percentage of "sequence identity" between a first nucleotide sequence and a second nucleotide sequence may be calculated by dividing [the number of nucleotides in the first nucleotide sequence that are identical to the nucleotides at the corresponding positions in the second nucleotide sequence] by [the total number of nucleotides in the first nucleotide sequence] and multiplying by [100%], in which each deletion, insertion, substitution or addition of a nucleotide in the second nucleotide sequence—compared to the first nucleotide sequence—is considered as a difference at a single nucleotide (position). Alternatively, the degree of sequence identity between two or more nucleotide sequences may be calculated using a known computer algorithm for sequence alignment such as NCBI Blast v2.0, using standard settings.

Some other techniques, computer algorithms and settings for determining the degree of sequence identity are for example described in WO 04/037999, EP 0 967 284, EP 1 085 089, WO 00/55318, WO 00/78972, WO 98/49185 and GB 2 357 768-A.

Usually, for the purpose of determining the percentage of "sequence identity" between two nucleotide sequences in accordance with the calculation method outlined hereinabove, the nucleotide sequence with the greatest number of nucleotides will be taken as the "first" nucleotide sequence, and the other nucleotide sequence will be taken as the "second" nucleotide sequence;

f) For the purposes of comparing two or more amino acid sequences, the percentage of "sequence identity" between a first amino acid sequence and a second amino acid sequence (also referred to herein as "amino acid identity") may be calculated by dividing [the number of amino acid residues in the first amino acid sequence that are identical to the amino acid residues at the corresponding positions in the second amino acid sequence] by [the total number of amino acid residues in the first amino acid sequence] and multiplying by [100%], in which each deletion, insertion, substitution or addition of an amino acid residue in the second amino acid sequence—compared to the first amino acid sequence—is considered as a difference at a single amino acid residue (position), i.e. as an "amino acid difference" as defined herein.

Alternatively, the degree of sequence identity between two amino acid sequences may be calculated using a known computer algorithm, such as those mentioned above for determining the degree of sequence identity for nucleotide sequences, again using standard settings.

Usually, for the purpose of determining the percentage of "sequence identity" between two amino acid sequences in accordance with the calculation method outlined hereinabove, the amino acid sequence with the greatest number of amino acid residues will be taken as the "first" amino acid sequence, and the other amino acid sequence will be taken as the "second" amino acid sequence.

Also, in determining the degree of sequence identity between two amino acid sequences, the skilled person may take into account so-called "conservative" amino acid substitutions, which can generally be described as amino acid substitutions in which an amino acid residue is replaced with another amino acid residue of similar chemical structure and which has little or essentially no influence on the function, activity or other biological properties of the polypeptide. Such conservative amino acid substitutions are well known in the art, for example from WO 04/037999, GB-A-3 357 768, WO 98/49185, WO 00/46383 and WO 01/09300; and (preferred) types and/or combinations of such substitutions may be selected on the basis of the pertinent teachings from WO 04/037999 as well as WO 98/49185 and from the further references cited therein.

Such conservative substitutions preferably are substitutions in which one amino acid within the following groups (a)-(e) is substituted by another amino acid residue within the same group: (a) small aliphatic, nonpolar or slightly polar residues: Ala, Ser, Thr, Pro and Gly; (b) polar, negatively charged residues and their (uncharged) amides: Asp, Asn, Glu and Gln; (c) polar, positively charged residues: His, Arg and Lys; (d) large aliphatic, nonpolar residues: Met, Leu, Ile, Val and Cys; and (e) aromatic residues: Phe, Tyr and Trp.

Particularly preferred conservative substitutions are as follows: Ala into Gly or into Ser; Arg into Lys; Asn into Gln or into His; Asp into Glu; Cys into Ser; Gln into Asn; Glu into Asp; Gly into Ala or into Pro; His into Asn or into Gln; Ile into Leu or into Val; Leu into Ile or into Val; Lys into Arg, into Gln or into Glu; Met into Leu, into Tyr or into Ile; Phe into Met, into Leu or into Tyr; Ser into Thr; Thr into Ser; Trp into Tyr; Tyr into Trp; and/or Phe into Val, into Ile or into Leu.

Any amino acid substitutions applied to the polypeptides described herein may also be based on the analysis of the frequencies of amino acid variations between homologous proteins of different species developed by Schulz et al., Principles of Protein Structure, Springer-Verlag, 1978, on the analyses of structure forming potentials developed by Chou and Fasman, Biochemistry 13: 211, 1974 and Adv. Enzymol., 47: 45-149, 1978, and on the analysis of hydrophobicity patterns in proteins developed by Eisenberg et al., Proc. Nad. Acad. Sci. USA 81: 140-144, 1984; Kyte & Doolittle; J Molec. Biol. 157: 105-132, 1981, and Goldman et al., Ann. Rev. Biophys. Chem. 15: 321-353, 1986, all incorporated herein in their entirety by reference. Information on the primary, secondary and tertiary structure of Nanobodies is given in the description herein and in the general background art cited above. Also, for this purpose, the crystal structure of a $V_{HH}$ domain from a llama is for example given by Desmyter et al., Nature Structural. Biology, Vol. 3, 9, 803 (1996); Spinelli et al., Natural Structural Biology (1996); 3, 752-757; and Decanniere et al., Structure, Vol. 7, 4, 361 (1999). Further information about some of the amino acid residues that in conventional $V_H$ domains form the $V_H/V_L$ interface and potential camelizing substitutions on these positions can be found in the prior art cited above.

g) Amino acid sequences and nucleic acid sequences are said to be "exactly the same" if they have 100% sequence identity (as defined herein) over their entire length;

h) When comparing two amino acid sequences, the term "amino acid difference" refers to an insertion, deletion or substitution of a single amino acid residue on a position of the first sequence, compared to the second sequence; it being understood that two amino acid sequences can contain one, two or more such amino acid differences;

i) When a nucleotide sequence or amino acid sequence is said to "comprise" another nucleotide sequence or amino acid sequence, respectively, or to "essentially consist of" another nucleotide sequence or amino acid sequence, this may mean that the latter nucleotide sequence or amino acid sequence has been incorporated into the firstmentioned nucleotide sequence or amino acid sequence, respectively, but more usually this generally means that the firstmentioned nucleotide sequence or amino acid sequence comprises within its sequence a stretch of nucleotides or amino acid residues, respectively, that has the same nucleotide sequence or amino acid sequence, respectively, as the latter sequence, irrespective of how the firstmentioned sequence has actually been generated or obtained (which may for example be by any suitable method described herein). By means of a non-limiting example, when a Nanobody of the invention is said to comprise a CDR sequence, this may mean that said CDR sequence has been incorporated into the Nanobody of the invention, but more usually this generally means that the Nanobody of the invention contains within its sequence a stretch of amino acid residues with the same amino acid sequence as said CDR sequence, irrespective of how said Nanobody of the invention has been generated or obtained. It should also be noted that when the latter amino acid sequence has a specific biological or structural function, it preferably has essentially the same, a similar or an equivalent biological or structural function in the firstmentioned amino acid sequence (in other words, the firstmentioned amino acid sequence is preferably such that the latter sequence is capable of performing essentially the same, a similar or an equivalent biological or structural function). For example, when a Nanobody of the invention is said to comprise a CDR sequence or framework sequence, respectively, the CDR sequence and framework are preferably capable, in said Nanobody, of functioning as a CDR sequence or framework sequence, respectively. Also, when a nucleotide sequence is said to comprise another nucleotide sequence, the firstmentioned nucleotide sequence is preferably such that, when it is expressed into an expression product (e.g. a polypeptide), the amino acid sequence encoded by the latter nucleotide sequence forms part of said expression product (in other words, that the latter nucleotide sequence is in the same reading frame as the firstmentioned, larger nucleotide sequence).

j) A nucleic acid sequence or amino acid sequence is considered to be "(in) essentially isolated (form)"—for example, compared to its native biological source and/or the reaction medium or cultivation medium from which it has been obtained—when it has been separated from at least one other component with which it is usually associated in said source or medium, such as another nucleic acid, another protein/polypeptide, another biological component or macromolecule or at least one contaminant, impurity or minor component. In particular, a nucleic acid sequence or amino acid sequence is considered "essentially isolated" when it has been purified at least 2-fold, in particular at least 10-fold, more in particular at least 100-fold, and up to 1000-fold or more. A nucleic acid sequence or amino acid sequence that is "in essentially isolated form" is preferably essentially homogeneous, as determined using a suitable technique, such as a suitable chromatographical technique, such as polyacrylamide-gel electrophoresis;

k) The term "domain" as used herein generally refers to a globular region of an amino acid sequence (such as an antibody chain, and in particular to a globular region of a heavy chain antibody), or to a polypeptide that essentially consists of such a globular region. Usually, such a domain will comprise peptide loops (for example 3 or 4 peptide loops) stabilized, for example, as a sheet or by disulfide bonds. The term "binding domain" refers to such a domain that is directed against an antigenic determinant (as defined herein);

l) The term "antigenic determinant" refers to the epitope on the antigen recognized by the antigen-binding molecule (such as a Nanobody or a polypeptide of the invention) and more in particular by the antigen-binding site of said molecule. The terms "antigenic determinant" and "epitope" may also be used interchangeably herein.

m) An amino acid sequence (such as a Nanobody, an antibody, a polypeptide of the invention, or generally an antigen binding protein or polypeptide or a fragment thereof) that can (specifically) bind to, that has affinity for and/or that has specificity for a specific antigenic determinant, epitope, antigen or protein (or for at least one part, fragment or epitope thereof) is said to be "against" or "directed against" said antigenic determinant, epitope, antigen or protein.

n) The term "specificity" refers to the number of different types of antigens or antigenic determinants to which a particular antigen-binding molecule or antigen-binding protein (such as a Nanobody or a polypeptide of the invention) molecule can bind. The specificity of an antigen-binding protein can be determined based on affinity and/or avidity. The affinity, represented by the equilibrium constant for the dissociation of an antigen with an antigen-binding protein ($K_D$), is a measure for the binding strength between an antigenic determinant and an antigen-binding site on the antigen-binding protein: the lesser the value of the $K_D$, the stronger the binding strength between an antigenic determinant and the antigen-binding molecule (alternatively, the affinity can also be expressed as the affinity constant ($K_A$), which is $1/K_D$). As will be clear to the skilled person (for example on the basis of the further disclosure herein), affinity can be determined in a manner known per se, depending on the specific antigen of interest. Avidity is the measure of the strength of binding between an antigen-binding molecule (such as a Nanobody or polypeptide of the invention) and the pertinent antigen. Avidity is related to both the affinity between an antigenic determinant and its antigen binding site on the antigen-binding molecule and the number of pertinent binding sites present on the antigen-binding molecule. Typically, antigen-binding proteins (such as the amino acid sequences, Nanobodies and/or polypeptides of the invention) will bind to their antigen with a dissociation constant ($K_D$) of $10^{-5}$ to $10^{-12}$ moles/liter or less, and preferably $10^{-7}$ to $10^{-12}$ moles/liter or less and more preferably $10^{-8}$ to $10^{-12}$ moles/liter (i.e. with an association constant ($K_A$) of $10^5$ to $10^{12}$ liter/moles or more, and preferably $10^7$ to $10^{12}$ liter/moles or more and more preferably $10^8$ to $10^{12}$ liter/moles). Any $K_D$ value greater than $10^4$ mol/liter (or any $K_A$ value lower than $10^4$ $M^{-1}$) liters/mol is generally considered to indicate non-specific binding. Preferably, a monovalent immunoglobulin sequence of the invention will bind to the desired antigen with an affinity less than 500 nM, preferably less than 200 nM, more preferably less than 10 nM, such as less than 500 pM. Specific binding of an antigen-binding protein to an antigen or antigenic determinant can be determined in any suitable manner known per se, including, for example, Scatchard analysis and/or competitive binding assays, such as radioimmunoassays (RIA), enzyme immunoassays (EIA) and sandwich competition assays, and the different variants thereof known per se in the art; as well as the other techniques mentioned herein.

The dissociation constant may be the actual or apparent dissociation constant, as will be clear to the skilled person. Methods for determining the dissociation constant will be clear to the skilled person, and for example include the techniques mentioned herein. In this respect, it will also be clear that it may not be possible to measure dissociation constants of more then $10^{-4}$ moles/liter or $10^{-3}$ moles/liter (e.g. of $10^{-2}$ moles/liter). Optionally, as will also be clear to the skilled person, the (actual or apparent) dissociation constant may be calculated on the basis of the (actual or apparent) association constant ($K_A$), by means of the relationship [$K_D=1/K_A$].

The affinity denotes the strength or stability of a molecular interaction. The affinity is commonly given as by the $K_D$, or dissociation constant, which has units of mol/liter (or M). The affinity can also be expressed as an association constant, $K_A$, which equals $1/K_D$ and has units of (mol/liter)$^{-1}$ (or $M^{-1}$). In the present specification, the stability of the interaction between two molecules (such as an amino acid sequence, Nanobody or polypeptide of the invention and its intended target) will mainly be expressed in terms of the $K_D$ value of their interaction; it being clear to the skilled person that in view of the relation $K_A=1/K_D$, specifying the strength of molecular interaction by its $K_D$ value can also be used to calculate the corresponding $K_A$ value. The $K_D$-value characterizes the strength of a molecular interaction also in a thermodynamic sense as it is related to the free energy (DG) of binding by the well known relation DG=RT·ln($K_D$) (equivalently DG=−RT·ln($K_A$)), where R equals the gas constant, T equals the absolute temperature and ln denotes the natural logarithm.

The $K_D$ for biological interactions which are considered meaningful (e.g. specific) are typically in the range of $10^{-10}$M (0.1 nM) to $10^{-5}$M (10000 nM). The stronger an interaction is, the lower is its $K_D$.

The $K_D$ can also be expressed as the ratio of the dissociation rate constant of a complex, denoted as $k_{off}$, to the rate of its association, denoted $k_{on}$ (so that $K_D=k_{off}/k_{on}$ and $K_A=k_{on}/k_{off}$). The off-rate $k_{off}$ has units s$^{-1}$ (where s is the SI unit notation of second). The on-rate $k_{on}$ has units $M^{-1}$ s$^{-1}$. The on-rate may vary between $10^2$ $M^{-1}$ s$^{-1}$ to about $10^7$ $M^{-1}$ s$^{-1}$, approaching the diffusion-limited association rate constant for bimolecular interactions. The off-rate is related to the half-life of a given molecular interaction by the relation $t_{1/2}=\ln(2)/k_{off}$. The off-rate may vary between $10^{-6}$ s$^{-1}$ (near irreversible complex with a $t_{1/2}$ of multiple days) to 1 s$^{-1}$ ($t_{1/2}=0.69$ s).

The affinity of a molecular interaction between two molecules can be measured via different techniques known per se, such as the well known surface plasmon resonance (SPR) biosensor technique (see for example Ober et al., Intern. Immunology, 13, 1551-1559, 2001) where one molecule is immobilized on the biosensor chip and the other molecule is passed over the immobilized molecule under flow conditions yielding $k_{on}$, $k_{off}$ measurements and hence $K_D$ (or $K_A$) values. This can for example be performed using the well-known BIACORE instruments.

It will also be clear to the skilled person that the measured $K_D$ may correspond to the apparent $K_D$ if the measuring process somehow influences the intrinsic binding affinity of the implied molecules for example by artefacts related to the coating on the biosensor of one molecule. Also, an apparent $K_D$ may be measured if one molecule contains more than one recognition sites for the other molecule. In such situation the measured affinity may be affected by the avidity of the interaction by the two molecules.

Another approach that may be used to assess affinity is the 2-step ELISA (Enzyme-Linked Immunosorbent Assay) procedure of Friguet et al. (J. Immunol. Methods, 77, 305-19, 1985). This method establishes a solution phase binding equilibrium measurement and avoids possible artefacts relating to adsorption of one of the molecules on a support such as plastic.

However, the accurate measurement of $K_D$ may be quite labor-intensive and as consequence, often apparent $K_D$ values are determined to assess the binding strength of two molecules. It should be noted that as long all measurements are made in a consistent way (e.g. keeping the assay conditions unchanged) apparent $K_D$ measurements can be used as an approximation of the true $K_D$ and hence in the present document $K_D$ and apparent $K_D$ should be treated with equal importance or relevance. Finally, it should be noted that in many situations the experienced scientist may judge it to be convenient to determine the binding affinity relative to some reference molecule. For example, to assess the binding strength between molecules A and B, one may e.g. use a reference molecule C that is known to bind to B and that is suitably labelled with a fluorophore or chromophore group or other chemical moiety, such as biotin for easy detection in an ELISA or FACS (Fluorescent activated cell sorting) or other format (the fluorophore for fluorescence detection, the chromophore for light absorption detection, the biotin for streptavidin-mediated ELISA detection). Typically, the reference molecule C is kept at a fixed concentration and the concentration of A is varied for a given concentration or amount of B. As a result an $IC_{50}$ value is obtained corresponding to the concentration of A at which the signal measured for C in absence of A is halved. Provided $K_{D\ ref}$, the $K_D$ of the reference molecule, is known, as well as the total concentration $c_{ref}$ of the reference molecule, the apparent $K_D$ for the interaction A-B can be obtained from following formula: $K_D=IC_{50}/(1+c_{ref}/K_{D\ ref})$. Note that if $c_{ref}\ll K_{D\ ref}$, $K_D\approx IC_{50}$. Provided the measurement of the $IC_{50}$ is performed in a consistent way (e.g. keeping $c_{ref}$ fixed) for the binders that are compared, the strength or stability of a molecular interaction can be assessed by the $IC_{50}$ and this measurement is judged as equivalent to $K_D$ or to apparent $K_D$ throughout this text.

o) The half-life of an amino acid sequence, compound or polypeptide of the invention can generally be defined as the time taken for the serum concentration of the amino acid sequence, compound or polypeptide to be reduced by 50%, in vivo, for example due to degradation of the sequence or compound and/or clearance or sequestration of the sequence or compound by natural mechanisms. The in vivo half-life of an amino acid sequence, compound or polypeptide of the invention can be determined in any manner known per se, such as by pharmacokinetic analysis. Suitable techniques will be clear to the person skilled in the art, and may for example generally involve the steps of suitably administering to a warm-blooded animal (i.e. to a human or to another suitable mammal, such as a mouse, rabbit, rat, pig, dog or a primate, for example monkeys from the genus *Macaca* (such as, and in particular, cynomolgus monkeys (*Macaca fascicularis*) and/or rhesus monkeys (*Macaca mulatta*)) and baboon (*Papio ursinus*)) a suitable dose of the amino acid sequence, compound or polypeptide of the invention; collecting blood samples or other samples from said animal; determining the level or concentration of the amino acid sequence, compound or polypeptide of the invention in said blood sample; and calculating, from (a plot of) the data thus obtained, the time until the level or concentration of the amino acid sequence, compound or polypeptide of the invention has been reduced by 50% compared to the initial level upon dosing. Reference is for example made to the Experimental Part below, as well as to the standard handbooks, such as Kenneth, A et al: Chemical Stability of Pharmaceuticals: A Handbook for Pharmacists and Peters et al, Pharmacokinete analysis: A Practical Approach (1996). Reference is also made to "Pharmacokinetics", M Gibaldi & D Perron, published by Marcel Dekker, 2nd Rev. edition (1982).

As will also be clear to the skilled person (see for example pages 6 and 7 of WO 04/003019 and in the further references cited therein), the half-life can be expressed using parameters such as the t1/2-alpha, t1/2-beta and the area under the curve (AUC). In the present specification, an "increase in half-life" refers to an increase in any one of these parameters, such as any two of these parameters, or essentially all three these parameters. As used herein "increase in half-life" or "increased half-life" in particular refers to an increase in the t1/2-beta, either with or without an increase in the t1/2-alpha and/or the AUC or both.

p) In the context of the present invention, "modulating" or "to modulate" generally means either reducing or inhibiting the activity of, or alternatively increasing the activity of, a target or antigen, as measured using a suitable in vitro, cellular or in vivo assay. In particular, "modulating" or "to modulate" may mean either reducing or inhibiting the activity of, or alternatively increasing a (relevant or intended) biological activity of, a target or antigen, as measured using a suitable in vitro, cellular or in vivo assay (which will usually depend on the target or antigen involved), by at least 1%, preferably at least 5%, such as at least 10% or at least 25%, for example by at least 50%, at least 60%, at least 70%, at least 80%, or 90% or more, compared to activity of the target or antigen in the same assay under the same conditions but without the presence of the construct of the invention.

As will be clear to the skilled person, "modulating" may also involve effecting a change (which may either be an increase or a decrease) in affinity, avidity, specificity and/or selectivity of a target or antigen for one or more of its ligands, binding partners, partners for association into a homomultimeric or heteromultimeric form, or substrates; and/or effecting a change (which may either be an increase or a decrease) in the sensitivity of the target or antigen for one or more conditions in the medium or surroundings in which the target or antigen is present (such as pH, ion strength, the presence of co-factors, etc.), compared to the same conditions but without the presence of the construct of the invention. As will be clear to the skilled person, this may again be determined in any suitable manner and/or using any suitable assay known per se, depending on the target or antigen involved.

"Modulating" may also mean effecting a change (i.e. an activity as an agonist, as an antagonist or as a reverse agonist, respectively, depending on the target or antigen and the desired biological or physiological effect) with respect to one or more biological or physiological mechanisms, effects, responses, functions, pathways or activities in which the target or antigen (or in which its substrate(s), ligand(s) or pathway(s) are involved, such as its signalling pathway or metabolic pathway and their associated biological or physiological effects) is involved. Again, as will be clear to the skilled person, such an action as an agonist or an antagonist may be determined in any suitable manner and/or using any suitable (in vitro and usually cellular or in assay) assay known per se, depending on the target or antigen involved. In particular, an action as an agonist or antagonist may be such that an intended biological or physiological activity is increased or decreased, respectively, by at least 1%, preferably at least 5%, such as at least 10% or at least 25%, for example by at least 50%, at least 60%, at least 70%, at least 80%, or 90% or more, compared to the biological or physiological activity in the same assay under the same conditions but without the presence of the construct of the invention.

Modulating may for example also involve allosteric modulation of the target or antigen; and/or reducing or inhibiting the binding of the target or antigen to one of its substrates or ligands and/or competing with a natural ligand, substrate for binding to the target or antigen. Modulating may also involve activating the target or antigen or the mechanism or pathway in which it is involved. Modulating may for example also involve effecting a change in respect of the folding or confirmation of the target or antigen, or in respect of the ability of the target or antigen to fold, to change its confirmation (for example, upon binding of a ligand), to associate with other (sub)units, or to disassociate.

Modulating may for example also involve effecting a change in the ability of the target or antigen to transport other compounds or to serve as a channel for other compounds (such as ions).

Modulating may be reversible or irreversible, but for pharmaceutical and pharmacological purposes will usually be in a reversible manner.

q) In respect of a target or antigen, the term "interaction site" on the target or antigen means a site, epitope, antigenic determinant, part, domain or stretch of amino acid residues on the target or antigen that is a site for binding to a ligand, receptor or other binding partner, a catalytic site, a cleavage site, a site for allosteric interaction, a site involved in multimerisation (such as homomerization or heterodimerization) of the target or antigen; or any other site, epitope, antigenic determinant, part, domain or stretch of amino acid residues on the target or antigen that is involved in a biological action or mechanism of the target or antigen. More generally, an "interaction site" can be any site, epitope, antigenic determinant, part, domain or stretch of amino acid residues on the target or antigen to which an amino acid sequence or polypeptide of the invention can bind such that the target or antigen (and/or any pathway, interaction, signalling, biological mechanism or biological effect in which the target or antigen is involved) is modulated (as defined herein).

r) An amino acid sequence or polypeptide is said to be "specific for" a first target or antigen compared to a second target or antigen when is binds to the first antigen with an affinity (as described above, and suitably expressed as a $K_D$ value, $K_A$ value, $K_{off}$ rate and/or $K_{on}$ rate) that is at least 10 times, such as at least 100 times, and preferably at least 1000 times, and up to 10.000 times or more better than the affinity with which said amino acid sequence or polypeptide binds to the second target or polypeptide. For example, the first antigen may bind to the target or antigen with a $K_D$ value that is at least 10 times less, such as at least 100 times less, and preferably at least 1000 times less, such as 10.000 times less or even less than that, than the $K_D$ with which said amino acid sequence or polypeptide binds to the second target or polypeptide. Preferably, when an amino acid sequence or polypeptide is "specific for" a first target or antigen compared to a second target or antigen, it is directed against (as defined herein) said first target or antigen, but not directed against said second target or antigen.

s) The terms "cross-block", "cross-blocked" and "cross-blocking" are used interchangeably herein to mean the ability of an amino acid sequence or other binding agents (such as a Nanobody, polypeptide or compound or construct of the invention) to interfere with the binding of other amino acid sequences or binding agents of the invention to a given target. The extend to which an amino acid sequence or other binding agents of the invention is able to interfere with the binding of another to HER2, and therefore whether it can be said to cross-block according to the invention, can be determined using competition binding assays. One particularly suitable quantitative cross-blocking assay uses a Biacore instrument which can measure the extent of interactions using surface plasmon resonance technology. Another suitable quantitative cross-blocking assay uses an ELISA-based approach to measure competition between amino acid sequences or other binding agents in terms of their binding to the target. The following generally describes a suitable Biacore assay for determining whether an amino acid sequence or other binding agent cross-blocks or is capable of cross-blocking according to the invention. It will be appreciated that the assay can be used with any of the amino acid sequences or other binding agents described herein. The Biacore machine (for example the Biacore 3000) is operated in line with the manufacturer's recommendations. Thus in one cross-blocking assay, the target protein is coupled to a CM5 Biacore chip using standard amine coupling chemistry to generate a surface that is coated with the target. Typically 200-800 resonance units of the target would be coupled to the chip (an amount that gives easily measurable levels of binding but that is readily saturable by the concentrations of test reagent being used). Two test amino acid sequences (termed A* and B*) to be assessed for their ability to cross-block each other are mixed at a one to one molar ratio of binding sites in a suitable buffer to create the test mixture. When calculating the concentrations on a binding site basis the molecular weight of an amino acid sequence is assumed to be the total molecular weight of the amino acid sequence divided by the number of target binding sites on that amino acid sequence. The concentration of each amino acid sequence in the test mix should be high enough to readily saturate the binding sites for that amino acid sequence on the target molecules captured on the Biacore chip. The amino acid sequences in the mixture are at the same molar concentration (on a binding basis) and that concentration would typically be between 1.00 and 1.5 micromolar (on a binding site basis). Separate solutions containing A* alone and B* alone are also prepared. A* and B* in these solutions should be in the same buffer and at the same concentration as in the test mix. The test mixture is passed over the target-coated. Biacore chip and the total amount of binding recorded. The chip is then treated in such a way as to remove the bound amino acid sequences without damaging the chip-bound target. Typically this is done by treating the chip with 30 mM HCl for 60 seconds. The solution of A* alone is then passed over the target-coated surface and the amount of binding recorded. The chip is again treated to remove all of the bound amino acid sequences without damaging the chip-bound target. The solution of B* alone is then passed over the target-coated surface and the amount of binding recorded. The maximum theoretical binding of the mixture of A* and B* is next calculated, and is the sum of the binding of each amino acid sequence when passed over the target surface alone. If the actual recorded binding of the mixture is less than this theoretical maximum then the two amino acid sequences are cross-blocking each other. Thus, in general, a cross-blocking amino acid sequence or other binding agent according to the invention is one which will bind to the target in the above Biacore cross-blocking assay such that during the assay and in the presence of a second amino acid sequence or other binding agent of the invention the recorded binding is between 80% and 0.1% (e.g. 80% to 4%) of the maximum theoretical binding, specifically between 75% and 0.1% (e.g. 75% to 4%) of the maximum theoretical binding, and more specifically between 70% and 0.1% (e.g. 70% to 4%) of maximum theoretical binding (as just defined above) of the two amino acid sequences or binding agents in combination. The Biacore assay described above is a primary assay used to determine if amino acid sequences or other binding agents cross-block each other according to the invention. On rare occasions particular amino acid sequences or other binding agents may not bind to target coupled via amine chemistry to a CM5 Biacore chip (this usually occurs when the relevant binding site on target is masked or destroyed by the coupling to the chip). In such cases cross-blocking can be determined using a tagged version of the target, for example a N-terminal His-tagged version. In this particular format, an anti-His amino acid sequence would be coupled to the Biacore chip and then the His-tagged target would be passed over the surface of the chip and captured by the anti-His amino acid sequence. The cross blocking analysis would be carried out essentially as described above, except that after each chip regeneration cycle, new His-tagged target would be loaded back onto the anti-His amino acid sequence coated surface. In addition to the example given using N-terminal His-tagged [target], C-terminal His-tagged target could alternatively be used. Furthermore, various other tags and tag binding protein combinations that are known in the art could be used for such a cross-blocking analysis (e.g. HA tag with anti-HA antibodies; FLAG tag with anti-FLAG antibodies; biotin tag with streptavidin).

The following generally describes an ELISA assay for determining whether an amino acid sequence or other binding agent directed against a target cross-blocks or is capable of cross-blocking as defined herein. It will be appreciated that the assay can be used with any of the amino acid sequences (or other binding agents such as polypeptides of the invention) described herein. The general principal of the assay is to have an amino acid sequence or binding agent that is directed against the target coated onto the wells of an ELISA plate. An excess amount of a second, potentially cross-blocking, anti-target amino acid sequence is added in solution (i.e. not bound to the ELISA plate). A limited amount of the target is then added to the wells. The coated amino acid sequence and the amino acid sequence in solution compete for binding of the limited number of target molecules. The plate is washed to remove excess target that has not been bound by the coated amino acid sequence and to also remove the second, solution phase amino acid sequence as well as any complexes formed between the second, solution phase amino acid sequence and target. The amount of bound target is then measured using a reagent that is appropriate to detect the target. An amino acid sequence in solution that is able to cross-block the coated amino acid sequence will be able to cause a decrease in the number of target molecules that the coated amino acid sequence can bind relative to the number of target molecules that the coated amino acid sequence can bind in the absence of the second, solution phase, amino acid sequence. In the instance where the first amino acid sequence, e.g. an Ab-X, is chosen to be the immobilized amino acid sequence, it is coated onto the wells of the ELISA plate, after which the plates are blocked with a suitable blocking solution to minimize non-specific binding of reagents that are subsequently added. An excess amount of the second amino acid sequence, i.e. Ab-Y, is then added to the ELISA plate such that the moles of Ab-Y target binding sites per well are at least 10 fold higher than the moles of Ab-X target binding sites that were used, per well, during the coating of the ELISA plate. Target is then added such that the moles of target added per well are at least 25-fold lower than the moles of Ab-X target binding sites that were used for coating each well. Following a suitable incubation period the ELISA plate is washed and a reagent for detecting the target is added to measure the amount of target specifically bound by the coated anti-target amino acid sequence (in this case Ab-X). The background signal for the assay is defined as the signal obtained in wells with the coated amino acid sequence (in this case Ab-X), second solution phase amino acid sequence (in this case Ab-Y), target] buffer only (i.e. without target) and target detection reagents. The positive control signal for the assay is defined as the signal obtained in wells with the coated amino acid sequence (in this case Ab-X), second solution phase amino acid sequence buffer only (i.e. without second solution phase amino acid sequence), target and target detection reagents. The ELISA assay may be run in such a manner so as to have the positive control signal be at least 6 times the background signal. To avoid any artefacts (e.g. significantly different affinities between Ab-X and Ab-Y for the target) resulting from the choice of which amino acid sequence to use as the coating amino acid sequence and which to use as the second (competitor) amino acid sequence, the cross-blocking assay may to be run in two formats: 1) format 1 is where Ab-X is the amino acid sequence that is coated onto the ELISA plate and Ab-Y is the competitor amino acid sequence that is in solution and 2) format 2 is where Ab-Y is the amino acid sequence that is coated onto the ELISA plate and Ab-X is the competitor amino acid sequence that is in solution. Ab-X and Ab-Y are defined as cross-blocking if, either in format 1 or in format 2, the solution phase anti-target amino acid sequence is able to cause a reduction of between 60% and 100%, specifically between 70% and 100%, and more specifically between 80% and 100%, of the target detection signal {i.e. the amount of target bound by the coated amino acid sequence) as compared to the target detection signal obtained in the absence of the solution phase anti-target amino acid sequence (i.e. the positive control wells).

t) An amino acid sequence is said to be "cross-reactive" for two different antigens or antigenic determinants (such as serum albumin from two different species of mammal, such as human serum albumin and cyno serum albumin) if it is specific for (as defined herein) both these different antigens or antigenic determinants.

u) By binding that is "essentially independent of the pH" is generally meant herein that the association constant ($K_A$) of the amino acid sequence with respect to the serum protein (such as serum albumin) at the pH value(s) that occur in a cell of an animal or human body (as further described herein) is at least 5%, such as at least 10%, preferably at least 25%, more preferably at least 50%, even more preferably at least 60%, such as even more preferably at least 70%, such as at least 80% or 90% or more (or even more than 100%, such as more than 110%, more than 120% or even 130% or more, or even more than 150%, or even more than 200%) of the association constant ($K_A$) of the amino acid sequence with respect to the same serum protein at the pH value(s) that occur outside said cell. Alternatively, by binding that is "essentially independent of the pH" is generally meant herein that the $k_{off}$ rate (measured by Biacore) of the amino acid sequence with respect to the serum protein (such as serum albumin) at the pH value(s) that occur in a cell of an animal or human body (as e.g. further described herein, e.g. pH around 5.5, e.g. 5.3 to 5.7) is at least 5%, such as at least 10%, preferably at least 25%, more preferably at least 50%, even more preferably at least 60%, such as even more preferably at least 70%, such as at least 80% or 90% or more (or even more than 100%, such as more than 110%, more than 120% or even 130% or more, or even more than 150%, or even more than 200%) of the $k_{off}$ rate of the amino acid sequence with respect to the same serum protein at the pH value(s) that occur outside said cell, e.g. pH 7.2 to 7.4. By "the pH value(s) that occur in a cell of an animal or human body" is meant the pH value(s) that may occur inside a cell, and in particular inside a cell that is involved in the recycling of the serum protein. In particular, by "the pH value(s) that occur in a cell of an animal or human body" is meant the pH value(s) that may occur inside a (sub)cellular compartment or vesicle that is involved in recycling of the serum protein (e.g. as a result of pinocytosis, endocytosis, transcytosis, exocytosis and phagocytosis or a similar mechanism of uptake or internalization into said cell), such as an endosome, lysosome or pinosome.

v) As further described herein, the total number of amino acid residues in a Nanobody can be in the region of 110-120, is preferably 112-115, and is most preferably 113. It should however be noted that parts, fragments, analogs or derivatives (as further described herein) of a Nanobody are not particularly limited as to their length and/or size, as long as such parts, fragments, analogs or derivatives meet the further requirements outlined herein and are also preferably suitable for the purposes described herein;

w) The amino acid residues of a Nanobody are numbered according to the general numbering for $V_H$ domains given by Kabat et al. ("Sequence of proteins of immunological interest", US Public Health Services, NIH Bethesda, Md., Publication No. 91), as applied to $V_{HH}$ domains from Camelids in the article of Riechmann and Muyldermans, J. Immunol. Methods 2000 Jun. 23; 240 (1-2): 185-195 (see for example FIG. 2 of this publication); or referred to herein. According to this numbering, FR1 of a Nanobody comprises the amino acid residues at positions 1-30, CDR1 of a Nanobody comprises the amino acid residues at positions 31-35, FR2 of a Nanobody comprises the amino acids at positions 36-49, CDR2 of a Nanobody comprises the amino acid residues at positions 50-65, FR3 of a Nanobody comprises the amino acid residues at positions 66-94, CDR3 of a Nanobody comprises the amino acid residues at positions 95-102, and FR4 of a Nanobody comprises the amino acid residues at positions 103-113. [In this respect, it should be noted that—as is well known in the art for $V_H$ domains and for $V_{HH}$ domains—the total number of amino acid residues in each of the CDR's may vary and may not correspond to the total number of amino acid residues indicated by the Kabat numbering (that is, one or more positions according to the Kabat numbering may not be occupied in the actual sequence, or the actual sequence may contain more amino acid residues than the number allowed for by the Kabat numbering). This means that, generally, the numbering according to Kabat may or may not correspond to the actual numbering of the amino acid residues in the actual sequence. Generally, however, it can be said that, according to the numbering of Kabat and irrespective of the number of amino acid residues in the CDR's, position I according to the Kabat numbering corresponds to the start of FR1 and vice versa, position 36 according to the Kabat numbering corresponds to the start of FR2 and vice versa, position 66 according to the Kabat numbering corresponds to the start of FR3 and vice versa, and position 103 according to the Kabat numbering corresponds to the start of FR4 and vice versa].

Alternative methods for numbering the amino acid residues of $V_H$ domains, which methods can also be applied in an analogous manner to $V_{HH}$ domains from Camelids and to Nanobodies, are the method described by Chothia et al. (Nature 342, 877-883 (1989)), the so-called "AbM definition" and the so-called "contact definition". However, in the present description, claims and figures, the numbering according to Kabat as applied to $V_{HH}$ domains by Riechmann and Muyldermans will be followed, unless indicated otherwise; and x) The Figures, Sequence Listing and the Experimental Part/Examples are only given to further illustrate the invention and should not be interpreted or construed as limiting the scope of the invention and/or of the appended claims in any way, unless explicitly indicated otherwise herein.

For a general description of heavy chain antibodies and the variable domains thereof, reference is inter alia made to the prior art cited herein, to the review article by Muyldermans in Reviews in Molecular Biotechnology 74(2001), 277-302; as well as to the following patent applications, which are mentioned as general background art: WO 94/04678, WO 95/04079 and WO 96/34103 of the Vrije Universiteit Brussel; WO 94/25591, WO 99/37681, WO 00/40968, WO 00/43507, WO 00/65057, WO 01/40310, WO 01/44301, EP 1134231 and WO 02/48193 of Unilever; WO 97/49805, WO 01/21817, WO 03/035694, WO 03/054016 and WO 03/055527 of the Vlaams Instituut voor Biotechnologie (VIB); WO 03/050531 of Algonomics N.V. and Ablynx N.V.; WO 01/90190 by the National Research Council of Canada; WO 03/025020 (=EP 1 433 793) by the Institute of Antibodies; as well as WO 04/041867, WO 04/041862, WO 04/041865, WO 04/041863, WO 04/062551, WO 05/044858, WO 06/40153, WO 06/079372, WO 06/122786, WO 06/122787 and WO 06/122825, by Ablynx N.V. and the further published patent applications by Ablynx N.V. Reference is also made to the further prior art mentioned in these applications, and in particular to the list of references mentioned on pages 41-43 of the International application WO 06/040153, which list and references are incorporated herein by reference.

In accordance with the terminology used in the art (see the above references), the variable domains present in naturally occurring heavy chain antibodies will also be referred to as "$V_{HH}$ domains", in order to distinguish them from the heavy chain variable domains that are present in conventional 4-chain antibodies (which will be referred to hereinbelow as "$V_H$ domains") and from the light chain variable domains that are present in conventional 4-chain antibodies (which will be referred to hereinbelow as "$V_L$ domains").

As mentioned in the prior art referred to above, $V_{HH}$ domains have a number of unique structural characteristics and functional properties which make isolated $V_{HH}$ domains (as well as Nanobodies based thereon, which share these structural characteristics and functional properties with the naturally occurring $V_{HH}$ domains) and proteins containing the same highly advantageous for use as functional antigen-binding domains or proteins. In particular, and without being limited thereto, $V_{HH}$ domains (which have been "designed" by nature to functionally bind to an antigen without the presence of, and without any interaction with, a light chain variable domain) and Nanobodies can function as a single, relatively small, functional antigen-binding structural unit, domain or protein. This distinguishes the $V_{HH}$ domains from the $V_H$ and $V_L$ domains of conventional 4-chain antibodies, which by themselves are generally not suited for practical application as single antigen-binding proteins or domains, but need to be combined in some form or another to provide a functional antigen-binding unit (as in for example conventional antibody fragments such as Fab fragments; in ScFv's fragments, which consist of a $V_H$ domain covalently linked to a $V_L$ domain).

Because of these unique properties, the use of $V_{HH}$ domains and Nanobodies as single antigen-binding proteins or as antigen-binding domains (i.e. as part of a larger protein or polypeptide) offers a number of significant advantages over the use of conventional $V_H$ and $V_L$ domains, scFv's or conventional antibody fragments (such as Fab- or F(ab')$_2$-fragments):

only a single domain is required to bind an antigen with high affinity and with high selectivity, so that there is no need to have two separate domains present, nor to assure that these two domains are present in the right spatial conformation and configuration (i.e. through the use of especially designed linkers, as with scFv's);

$V_{HH}$ domains and Nanobodies can be expressed from a single gene and require no post-translational folding or modifications;

$V_{HH}$ domains and Nanobodies can easily be engineered into multivalent and multispecific formats (as further discussed herein);

$V_{HH}$ domains and Nanobodies are highly soluble and do not have a tendency to aggregate (as with the mouse-derived "dAb's" described by Ward et al., Nature, Vol. 341, 1989, p. 544);

$V_{HH}$ domains and Nanobodies are highly stable to heat, pH, proteases and other denaturing agents or conditions (see for example Ewert et al, supra);

$V_{HH}$ domains and Nanobodies are easy and relatively cheap to prepare, even on a scale required for production. For example, $V_{HH}$ domains, Nanobodies and proteins/polypeptides containing the same can be produced using microbial fermentation (e.g. as further described below) and do not require the use of mammalian expression systems, as with for example conventional antibody fragments;

$V_{HH}$ domains and Nanobodies are relatively small (approximately 15 kDa, or 10 times smaller than a conventional IgG) compared to conventional 4-chain antibodies and antigen-binding fragments thereof, and therefore show high(er) penetration into tissues (including but not limited to solid tumors and other dense tissues) than such conventional 4-chain antibodies and antigen-binding fragments thereof; $V_{HH}$ domains and Nanobodies can show so-called cavity-binding properties (inter alia due to their extended CDR3 loop, compared to conventional $V_H$ domains) and can therefore also access targets and epitopes not accessible to conventional 4-chain antibodies and antigen-binding fragments thereof. For example, it has been shown that $V_{HH}$ domains and Nanobodies can inhibit enzymes (see for example WO 97/49805; Transue et al., Proteins 1998 Sep. 1; 32(4): 515-22; Lauwereys et al., EMBO J. 1998 Jul. 1; 17(13): 3512-20).

In a specific and preferred aspect, the invention provides Nanobodies against HER2, and in particular Nanobodies against HER2 from a warm-blooded animal, and more in particular Nanobodies against HER2 from a mammal, and especially Nanobodies against human HER2; as well as proteins and/or polypeptides comprising at least one such Nanobody.

In particular, the invention provides Nanobodies against HER2, and proteins and/or polypeptides comprising the same, that have improved therapeutic and/or pharmacological properties and/or other advantageous properties (such as, for example, improved ease of preparation and/or reduced costs of goods), compared to conventional antibodies against HER2 or fragments thereof, compared to constructs that could be based on such conventional antibodies or antibody fragments (such as Fab' fragments, F(ab')$_2$ fragments, ScFv constructs, "diabodies" and other multispecific constructs (see for example the review by Holliger and Hudson, Nat. Biotechnol. 2005 September; 23(9):1126-36)), and also compared to the so-called "dAb's" or similar (single) domain antibodies that may be derived from variable domains of conventional antibodies. These improved and advantageous properties will become clear from the further description herein, and for example include, without limitation, one or more of:

increased affinity and/or avidity for HER2, either in a monovalent format, in a multivalent format (for example in a bivalent format) and/or in a multispecific format (for example one of the multispecific formats described hereinbelow);

better suitability for formatting in a multivalent format (for example in a bivalent format);

better suitability for formatting in a multispecific format (for example one of the multispecific formats described hereinbelow);

improved suitability or susceptibility for "humanizing" substitutions (as defined herein);

less immunogenicity, either in a monovalent format, in a multivalent format (for example in a bivalent format) and/or in a multispecific format (for example one of the multispecific formats described hereinbelow);

increased stability, either in a monovalent format, in a multivalent format (for example in a bivalent format) and/or in a multispecific format (for example one of the multispecific formats described hereinbelow);

increased specificity towards HER2, either in a monovalent format, in a multivalent format (for example in a bivalent format) and/or in a multispecific format (for example one of the multispecific formats described hereinbelow);

decreased or where desired increased cross-reactivity with HER2 from different species;

and/or one or more other improved properties desirable for pharmaceutical use (including prophylactic use and/or therapeutic use) and/or for diagnostic use (including but not limited to use for imaging purposes), either in a monovalent format, in a multivalent format (for example in a bivalent format) and/or in a multispecific format (for example one of the multispecific formats described hereinbelow).

As generally described herein for the amino acid sequences of the invention, the Nanobodies of the invention are preferably in essentially isolated form (as defined herein), or form part of a protein or polypeptide of the invention (as defined herein), which may comprise or essentially consist of one or more Nanobodies of the invention and which may optionally further comprise one or more further amino acid sequences (all optionally linked via one or more suitable linkers). For example, and without limitation, the one or more amino acid sequences of the invention may be used as a binding unit in such a protein or polypeptide, which may optionally contain one or more further amino acid sequences that can serve as a binding unit (i.e. against one or more other antigenic determinants on HER2 and/or against one or more other targets than HER2), so as to provide a monovalent, multivalent, multiparatopic or multispecific polypeptide of the invention, respectively, all as described herein. In particular, such a protein or polypeptide may comprise or essentially consist of one or more Nanobodies of the invention and optionally one or more (other) Nanobodies (i.e. directed against one or more other antigenic determinants on HER2 and/or against other targets than HER2), all optionally linked via one or more suitable linkers, so as to provide a monovalent, multivalent, multiparatopic or multispecific Nanobody construct, respectively, as further described herein. Such proteins or polypeptides may also be in essentially isolated form (as defined herein).

In a Nanobody of the invention, the binding site for binding against HER2 is preferably formed by the CDR sequences. Optionally, a Nanobody of the invention may also, and in addition to the at least one binding site for binding against HER2, contain one or more further binding sites for binding against other antigens, proteins or targets. For methods and positions for introducing such second binding sites, reference is for example made to Keck and Huston, Biophysical Journal, 71, October 1996, 2002-2011; EP 0 640 130; and WO 06/07260.

As generally described herein for the amino acid sequences of the invention, when a Nanobody of the invention (or a polypeptide of the invention comprising the same) is intended for administration to a subject (for example for therapeutic and/or diagnostic purposes as described herein), it is preferably directed against human HER2; whereas for veterinary purposes, it is preferably directed against HER2 from the species to be treated.

Also, as with the amino acid sequences of the invention, a Nanobody of the invention may or may not be cross-reactive (i.e. directed against HER2 from two or more species of mammal, such as against human HER2 and HER2 from at least one of the species of mammal mentioned herein).

Also, again as generally described herein for the amino acid sequences of the invention, the Nanobodies of the invention may generally be directed against any antigenic determinant, epitope, part, domain, subunit or confirmation (where applicable) of HER2 However, it is generally assumed and preferred that the Nanobodies of the invention (and polypeptides comprising the same) are directed against the Herceptin® binding site on HER2 or the Omnitarg binding site on HER2.

As already described herein, the amino acid sequence and structure of a Nanobody can be considered—without however being limited thereto—to be comprised of four framework regions or "FR's" (or sometimes also referred to as "FW's"), which are referred to in the art and herein as "Framework region 1" or "FR1"; as "Framework region 2" or "FR2"; as "Framework region 3" or "FR3"; and as "Framework region 4" or "FR4", respectively; which framework regions are interrupted by three complementary determining regions or "CDR's", which are referred to in the art as "Complementarity Determining Region 1" or "CDR1"; as "Complementarity Determining Region 2" or "CDR2"; and as "Complementarity Determining Region 3" or "CDR3", respectively. Some preferred framework sequences and CDR's (and combinations thereof) that are present in the Nanobodies of the invention are as described herein. Other suitable CDR sequences can be obtained by the methods described herein.

According to a non-limiting but preferred aspect of the invention, (the CDR sequences present in) the Nanobodies of the invention are such that:

the Nanobodies can bind to HER2 with a dissociation constant ($K_D$) of $10^{-5}$ to $10^{-12}$ moles/liter or less, and preferably $10^{-7}$ to $10^{-12}$ moles/liter or less and more preferably $10^{-8}$ to $10^{-12}$ moles/liter (i.e. with an association constant ($K_A$) of $10^5$ to $10^{12}$ liter/moles or more, and preferably $10^7$ to $10^{12}$ liter/moles or more and more preferably $10^8$ to $10^{12}$ liter/moles);

and/or such that:

the Nanobodies can bind to HER2 with a $k_{on}$-rate of between $10^2$ $M^{-1}$ $s^{-1}$ to about $10^7$ $M^{-1}$ $s^{-1}$, preferably between $10^3$ $M^{-1}$ $s^{-1}$ and $10^7$ $M^{-1}$ $s^{-1}$, more preferably between $10^4$ $M^{-1}$ $s^{-1}$ and $10^7$ $M^{-1}$ $s^{-1}$, such as between $10^5$ $M^{-1}$ $s^{-1}$ and $10^7$ $M^{-1}$ $s^{-1}$;

and/or such that they:

the Nanobodies can bind to HER2 with a $k_{off}$ rate between $1$ $s^{-1}$ ($t_{1/2}$=0.69 s) and $10^{-6}$ $s^{-1}$ (providing a near irreversible complex with a $t_{1/2}$ of multiple days), preferably between $10^{-2}$ $s^{-1}$ and $10^{-6}$ $s^{-1}$, more preferably between $10^{-3}$ $s^{-1}$ and $10^{-6}$ $s^{-1}$, such as between $10^{-4}$ $s^{-1}$ and $10^{-6}$ $s^{-1}$.

Preferably, (the CDR sequences present in) the Nanobodies of the invention are such that: a monovalent Nanobody of the invention (or a polypeptide that contains only one Nanobody of the invention) is preferably such that it will bind to HER2 with an affinity less than 500 nM, preferably less than 200 nM, more preferably less than 10 nM, such as less than 500 pM.

The affinity of the Nanobody of the invention against HER2 can be determined in a manner known per se, for example using the general techniques for measuring $K_D$, $K_A$, $k_{off}$ or $k_{on}$ mentioned herein, as well as some of the specific assays described herein.

Some preferred IC 50 values for binding of the Nanobodies of the invention (and of polypeptides comprising the same) to HER2 will become clear from the further description and examples herein.

In a preferred but non-limiting aspect, the invention relates to a Nanobody (as defined herein) against HER2, which consists of 4 framework regions (FR1 to FR4 respectively) and 3 complementarity determining regions (CDR1 to CDR3 respectively), in which:

CDR1 is chosen from the group consisting of:
a) the amino acid sequences of SEQ ID NO's: 401-675;
b) amino acid sequences that have at least 80% amino acid identity with at least one of the amino acid sequences of SEQ ID NO's: 401-675;
c) amino acid sequences that have 3, 2, or 1 amino acid difference with at least one of the amino acid sequences of SEQ ID NO's: 401-675;

and/or

CDR2 is chosen from the group consisting of:
d) the amino acid sequences of SEQ ID NO's: 951-1225;
e) amino acid sequences that have at least 80% amino acid identity with at least one of the amino acid sequences of SEQ ID NO's: 951-1225;

f) amino acid sequences that have 3, 2, or 1 amino acid difference with at least one of the amino acid sequences of SEQ ID NO's: 951-1225;
and/or
CDR3 is chosen from the group consisting of:
g) the amino acid sequences of SEQ ID NO's: 1501-1775;
h) amino acid sequences that have at least 80% amino acid identity with at least one of the amino acid sequences of SEQ ID NO's: 1501-1775;
i) amino acid sequences that have 3, 2, or 1 amino acid difference with at least one of the amino acid sequences of SEQ ID NO's: 1501-1775;
or any suitable fragment of such an amino acid sequence.

In particular, according to this preferred but non-limiting aspect, the invention relates to a Nanobody (as defined herein) against HER2, which consists of 4 framework regions (FR1 to FR4 respectively) and 3 complementarity determining regions (CDR1 to CDR3 respectively), in which:
CDR1 is chosen from the group consisting of:
a) the amino acid sequences of SEQ ID NO's: 401-675;
b) amino acid sequences that have at least 80% amino acid identity with at least one of the amino acid sequences of SEQ ID NO's: 401-675;
c) amino acid sequences that have 3, 2, or 1 amino acid difference with at least one of the amino acid sequences of SEQ ID NO's: 401-675;
and
CDR2 is chosen from the group consisting of:
d) the amino acid sequences of SEQ ID NO's: 951-1225;
e) amino acid sequences that have at least 80% amino acid identity with at least one of the amino acid sequences of SEQ ID NO's: 951-1225;
f) amino acid sequences that have 3, 2, or 1 amino acid difference with at least one of the amino acid sequences of SEQ ID NO's: 951-1225;
and
CDR3 is chosen from the group consisting of:
g) the amino acid sequences of SEQ ID NO's: 1501-1775;
h) amino acid sequences that have at least 80% amino acid identity with at least one of the amino acid sequences of SEQ ID NO's: 1501-1775;
i) amino acid sequences that have 3, 2, or 1 amino acid difference with at least one of the amino acid sequences of SEQ ID NO's: 1501-1775;
or any suitable fragment of such an amino acid sequences.

As generally mentioned herein for the amino acid sequences of the invention, when a Nanobody of the invention contains one or more CDR1 sequences according to b) and/or c):
i) any amino acid substitution in such a CDR according to b) and/or c) is preferably, and compared to the corresponding CDR according to a), a conservative amino acid substitution (as defined herein);
and/or
ii) the CDR according to b) and/or c) preferably only contains amino acid substitutions, and no amino acid deletions or insertions, compared to the corresponding CDR according to a);
and/or
iii) the CDR according to b) and/or c) may be a CDR that is derived from a CDR according to a) by means of affinity maturation using one or more techniques of affinity maturation known per se.

Similarly, when a Nanobody of the invention contains one or more CDR2 sequences according to e) and/or f):
i) any amino acid substitution in such a CDR according to e) and/or f) is preferably, and compared to the corresponding CDR according to d), a conservative amino acid substitution (as defined herein);
and/or
ii) the CDR according to e) and/or f) preferably only contains amino acid substitutions, and no amino acid deletions or insertions, compared to the corresponding CDR according to d);
and/or
iii) the CDR according to e) and/or f) may be a CDR that is derived from a CDR according to d) by means of affinity maturation using one or more techniques of affinity maturation known per se.

Also, similarly, when a Nanobody of the invention contains one or more CDR3 sequences according to h) and/or i):
i) any amino acid substitution in such a CDR according to h) and/or i) is preferably, and compared to the corresponding CDR according to g), a conservative amino acid substitution (as defined herein);
and/or
ii) the CDR according to h) and/or i) preferably only contains amino acid substitutions, and no amino acid deletions or insertions, compared to the corresponding CDR according to g);
and/or
iii) the CDR according to h) and/or i) may be a CDR that is derived from a CDR according to g) by means of affinity maturation using one or more techniques of affinity maturation known per se.

It should be understood that the last three paragraphs generally apply to any Nanobody of the invention that comprises one or more CDR1 sequences, CDR2 sequences and/or CDR3 sequences according to b), c), e), f), h) or i), respectively.

Of the Nanobodies of the invention, Nanobodies comprising one or more of the CDR's explicitly listed above are particularly preferred; Nanobodies comprising two or more of the CDR's explicitly listed above are more particularly preferred; and Nanobodies comprising three of the CDR's explicitly listed above are most particularly preferred.

Some particularly preferred, but non-limiting combinations of CDR sequences, as well as preferred combinations of CDR sequences and framework sequences, are mentioned in Table A-1 below, which lists the CDR sequences and framework sequences that are present in a number of preferred (but non-limiting) Nanobodies of the invention. As will be clear to the skilled person, a combination of CDR1, CDR2 and CDR3 sequences that occur in the same clone (i.e. CDR1, CDR2 and CDR3 sequences that are mentioned on the same line in Table A-1) will usually be preferred (although the invention in its broadest sense is not limited thereto, and also comprises other suitable combinations of the CDR sequences mentioned in Table A-1). Also, a combination of CDR sequences and framework sequences that occur in the same clone (i.e. CDR sequences and framework sequences that are mentioned on the same line in Table A-1) will usually be preferred (although the invention in its broadest sense is not limited thereto, and also comprises other suitable combinations of the CDR sequences and framework sequences mentioned in Table A-1, as well as combinations of such CDR sequences and other suitable framework sequences, e.g. as further described herein).

Also, in the Nanobodies of the invention that comprise the combinations of CDR's mentioned in Table A-1, each CDR can be replaced by a CDR chosen from the group consisting of amino acid sequences that have at least 80%, preferably at least 90%, more preferably at least 95%, even more preferably at least 99% sequence identity (as defined herein) with the mentioned CDR's; in which:
i) any amino acid substitution in such a CDR is preferably, and compared to the corresponding CDR sequence mentioned in Table A-1, a conservative amino acid substitution (as defined herein);
and/or
ii) any such CDR sequence preferably only contains amino acid substitutions, and no amino acid deletions or insertions, compared to the corresponding CDR sequence mentioned in Table A-1;
and/or
iii) any such CDR sequence is a CDR that is derived by means of a technique for affinity maturation known per se, and in particular starting from the corresponding CDR sequence mentioned in Table A-1.

However, as will be clear to the skilled person, the (combinations of) CDR sequences, as well as (the combinations of) CDR sequences and framework sequences mentioned in Table A-1 will generally be preferred.

TABLE A-1

Preferred combinations of CDR sequences, preferred combinations of framework sequences, and preferred combinations of framework and CDR sequences.
("ID" refers to the SEQ ID NO in the attached sequence listing)

| Clone | ID | FR1 | ID | CDR 1 | ID | FR2 | ID | CDR 2 | ID |
|---|---|---|---|---|---|---|---|---|---|
| 13D11 | 126 | EVQLVESGGGLV HPGGSLRLSCVG SGFSLD | 401 | DYGMT | 676 | WVRRAPGK GLEWVS | 951 | SINWSGTHTDY ADSVKG | 1226 |
| 2B4 | 127 | EVQLVESGGGLV QPGGSLRLSCVG SGFSLD | 402 | DYAMT | 677 | WVRQAPGK GLEWVS | 952 | SINWSGTHTDY ADSVKG | 1227 |
| 2G2 | 128 | EVQLVESGGGLV QPGGSLRLSCVA SGFSLD | 403 | DYGMT | 678 | WVRQAPGK GLEWVS | 953 | SINWSGTHTDY TDPVKG | 1228 |
| 13D2 | 129 | EVQLVESGGGLV QPGGSLRLSCVA SGFSLD | 404 | DYGMT | 679 | WVRQAPGK GLEWVS | 954 | SINWSGTHTDY ADSVKG | 1229 |
| 2D5 | 130 | EVQLVESGGGLV QPGGSLRLSCVA SGFSLD | 405 | DYGMT | 680 | WVRQAPGK GLEWVS | 955 | SINWSGTHTDY ADSVKG | 1230 |
| 2F4 | 131 | EVQLVESGGGLV QPGGSLRLSCVA SGFSLD | 406 | DYGMT | 681 | WVRQAPGK GLEWVS | 956 | SINWSGTHTDY ADSVKG | 1231 |
| 2C3 | 132 | EVQLVESGGGLV QPGGSLRLSCVA SGFSLD | 407 | DYGMT | 682 | WVRQAPGK GLEWVS | 957 | SINWSGTHTDY ADSVKG | 1232 |
| 17E3 | 133 | EVQLVESGGGLV QAGGSLRLSCVA SKMTFM | 408 | RYTMG | 683 | WYRQAPGK QRDLVA | 958 | SIDSSGGTNYA DSVKG | 1233 |
| 17H3 | 134 | EVQLMESGGGLV QPGGSLRLSCVA SGFSLD | 409 | DYGMT | 684 | WVRQAPGK GLEWVS | 959 | SINWSGTHTDY ADSVKG | 1234 |
| 17D2 | 135 | EVQLVESGGGLV QPGGSLRLSCVA SGFSLD | 410 | DYGMT | 685 | WVRQAPGK GLEWVS | 960 | SINWSGTHTDY ADSVKG | 1235 |
| 2F1 | 136 | EVQLVESGGGLV QPGGSLRLSCVA SGFSLD | 411 | DYGMT | 686 | WVRQAPGK ELEWIS | 961 | SINWSGTHTDY ADSVKG | 1236 |
| 2E2 | 137 | EVQLVESGGGLV QPGGSLRLSCVA SGFSLD | 412 | DYGMT | 687 | WVRQAPGK GLEWVS | 962 | SINWSGTHTDY ADSVKG | 1237 |
| 2C2 | 138 | EVQLVESGGGLV QPGGSLRLSCVA SGFSLD | 413 | DYAMT | 688 | WVRQAPGK GLEWVS | 963 | SINWSGTHTDY ADSVKG | 1238 |
| 2E3 | 139 | EVQLVESGGGLV QPGGSLRLSCVA SGFSLD | 414 | DYGMT | 689 | WVRQAPGK GLEWVS | 964 | SINWSGTHTDY ADSVKG | 1239 |

TABLE A-1 -continued

Preferred combinations of CDR sequences, preferred combinations of framework sequences, and preferred combinations of framework and CDR sequences.
("ID" refers to the SEQ ID NO in the attached sequence listing)

| Name | ID | Seq1 | ID | Seq2 | ID | Seq3 | ID | Seq4 | ID |
|---|---|---|---|---|---|---|---|---|---|
| 13B10 | 140 | EVQLVESGGGLVQPGGSLRLSCVASGFSLD | 415 | DYGMT | 690 | WVRQAPGKGFEWVS | 965 | SINWSGTHTDYADSVKG | 1240 |
| 2D1 | 141 | EVQLVESGGGLVQPGGSLRLSCVASGFSLD | 416 | DYGMT | 691 | WVRQAPGKGLEWVS | 966 | SINWSGTHTDYADSVKG | 1241 |
| 2H3 | 142 | EVQLVESGGGLVQPGGSLRLSCVASGFSLD | 417 | DYGMT | 692 | WVRQAPGKGLEWVS | 967 | SINWSGTHTDYADSVKG | 1242 |
| 2H1 | 143 | EVQLVESGGGLVQPGGSLRLSCVASGFSLD | 418 | DYGMT | 693 | WVRQAPGKGLEWVS | 968 | SINWSGTHTDYADSVRG | 1243 |
| 2C1 | 144 | EVQLVESGGGLVQPGGSLRLSCVASGFSLD | 419 | DYGMT | 694 | WVRQAPGKGLEWVS | 969 | SINWSGTHTDYTDSVKG | 1244 |
| 15C5 | 145 | EVQLVESGGGLVQPGGSLKLSCVASGFSLD | 420 | DYGMT | 695 | WVRQAPGKGLEWVS | 970 | SINWNVTHTDYAYSVKG | 1245 |
| 2B3 | 146 | EVQLVESGGGLVQPGGSLRLSCVASGFSLD | 421 | DYGMT | 696 | WVRQAPGKGLEWVS | 971 | SINWSGTHTDCADSVKG | 1246 |
| 29H2 | 147 | EVQLVESGGGLVQPGGSLRLSCVASGFSLD | 422 | DYGMT | 697 | WVRQAPGKGLEWVS | 972 | SINWSGTHTDYADSVKG | 1247 |
| 17E4 | 148 | EVQLVESGGGLVQPGGSLRLSCVASGFSLD | 423 | DYGMT | 698 | WVRQAPGKGLEWVS | 973 | SINWSGTHTDYADSVKG | 1248 |
| 17A2 | 149 | EVQLVESGGGLVQPGGSLRLSCVASGFSLD | 424 | DYAMT | 699 | WVRQAPGKGLEWVS | 974 | SINWSGTHTDYADSVKG | 1249 |
| 15D1 | 150 | EVQLVESGGGLVQPGGSLRLSCVASGFSLD | 425 | DYAMT | 700 | WVRQAPGKGLEWVS | 975 | SINWSGTHTDYADSVKG | 1250 |
| 17B8 | 151 | EVQLVESGGGLVQPGGSLRLSCVASGFSLD | 426 | DYGMT | 701 | WVRQAPGKGLEWVS | 976 | SINWSGTHTDYADSVKG | 1251 |
| 15C11 | 152 | EVQLVESGGGLVQPGGSLRLSCVASGFSLD | 427 | DYGMT | 702 | WVRQAPGKGLEWVS | 977 | SINWSGTHTDYADSVKG | 1252 |
| 15G8 | 153 | EVQLVESGGGLVQPGGSLKLSCVASGFSLD | 428 | DYGMT | 703 | WVRQAPGKGLEWVS | 978 | SINWNGTHTDYAYSVKG | 1253 |
| 17H4 | 154 | EVQLVESGGGLVQPGGSLRLSCVASGFSLI | 429 | NYAMT | 704 | WVRQAPGKGLEWVS | 979 | SINWSGTHTDYADSVKG | 1254 |
| 27G8 | 155 | EVQLVESGGGLVQPGGSLRLSCVASGFSLD | 430 | DYGMT | 705 | WVRQAPGKGLEWVS | 980 | SINWSGTHTDYADSVKG | 1255 |
| 38C6 | 156 | EVQLVESGGGLVQPGGSLRLSCVGSGFSLD | 431 | DYAMT | 706 | WVRQAPGKGLEWVS | 981 | SINWSGTHTDYADSVKG | 1256 |
| 2A4 | 157 | EVQLVESGGGLVQPGGSLRLSCAASGFIFD | 432 | DYAMS | 707 | WVRQAPGKGLEWVS | 982 | AINWSGSHRNYADSVKG | 1257 |

TABLE A-1 -continued

Preferred combinations of CDR sequences, preferred combinations of framework sequences, and preferred combinations of framework and CDR sequences.
("ID" refers to the SEQ ID NO in the attached sequence listing)

| | | | | | | | |
|---|---|---|---|---|---|---|---|
| 15G7 | 158 | EVQLVESGGGLV QPGGSLRLSCAA SGFIFD | 433 | DYAMS | 708 | WVRQAPGK GLEWVS | 983 | AINWSGTHRN YADSVKG | 1258 |
| 15B7 | 159 | EVQLVESGGGLV QPGGSLKLSCAA SGFIFD | 434 | DYAMS | 709 | WVRQAPGK GLEWVS | 984 | AINWSGSHRN YADSVKG | 1259 |
| 5G4 | 160 | EVQLVESGGGLV QPGGSLTLSCAG SGFIFD | 435 | DYAMS | 710 | WVRQAPGK GLEWVS | 985 | SINWSGSHRN YADSVKG | 1260 |
| 13B2 | 161 | EVQLVESGGSLV QPGGSLRLSCAA SGFTFD | 436 | DYAMS | 711 | WVRQAPGK GLEWIS | 986 | SINWSGTHKDY ADSVKG | 1261 |
| 2E5 | 162 | EVQLVESGGSLV QPGESLRLSCAA SGFTFD | 437 | DYAMS | 712 | WVRQAPGK GLEWIS | 987 | SINWSGTHTDY ADSVKG | 1262 |
| 15G1 | 163 | EVQLVESGGSLV PPGGSLRLSCAA SGFTFD | 438 | DYAMS | 713 | WVRQAPGK GLEWVS | 988 | SINWSGTHTDY TDSVKG | 1263 |
| 27B1 | 164 | EVQLVESGGSLV QPGGSLRLSCAA SGFTFD | 439 | DYAMS | 714 | WVRQAPGK GLEWIS | 989 | SINWSGTHTDY ADSVKG | 1264 |
| 17E7 | 165 | EVQLVESGGSLV QPGGSLRLSCAA SGFTFD | 440 | DYAMS | 715 | WVRQVPGK GLEWVS | 990 | SINWSGTHTDY ADSVKG | 1265 |
| 17D8 | 166 | EVQLVESGGSLV PPGGSLRLSCAV SGFTFD | 441 | DYAMS | 716 | WVRQAPGK GLEWVS | 991 | SINWSGTHTDY TDSVKG | 1266 |
| 5F8 | 167 | EVQLVESGGSLV QPGGSLRLSCAA SGFTFD | 442 | DYALS | 717 | WVRQAPGK GLEWIS | 992 | SINWSGTHTDY ADSVKG | 1267 |
| 2D4 | 168 | EVQLVESGGSLV QPGGSLRLSCAA SGFTFD | 443 | DYAMT | 718 | WVRQAPGK GLEWVS | 993 | SINWSGTHTDY ADSVKG | 1268 |
| 13D8 | 169 | EVQLVESGGSLV QPGGSLRLSCAA SGFTFD | 444 | DYAMT | 719 | WVRQASGK GLEWVS | 994 | SINWSGTHTDY TDSVKG | 1269 |
| 17G8 | 170 | EVQLVESGGSLV PPGGSLRLSCAA SGFTFD | 445 | DYAMS | 720 | WVRQAPGK GLEWVS | 995 | SINWSGTHTGY TDSVKG | 1270 |
| 2H4 | 171 | EVQLVESGGSLV QPGGSLRLSCAA SGFTFD | 446 | DYAMT | 721 | WVRQAPGK GLEWVS | 996 | SINWSGTHTDY TDSVKG | 1271 |
| 2F3 | 172 | EVQLVESGGSLV QPGGSLRLSCAA SGFTFD | 447 | DYAMT | 722 | WVRQAPGK GLEWVS | 997 | SINWSGTHTDY TGSVKG | 1272 |
| 2F5 | 173 | EVQLVESGGSLV PPGGSLRLSCAA SGFTFD | 448 | DYAMS | 723 | WVRQAPGK GLEWVS | 998 | SINWSGTHTDY TDSVKG | 1273 |
| 30E10 | 174 | KVQLVESGGSLV PPGGSLRLSCAA SGFTFD | 449 | DYAMT | 724 | WVRQAPGK GLEWVS | 999 | SINWSGTHTDY TDSVKG | 1274 |
| 29H1 | 175 | EVQLVESGGSLV PPGGSLRLSCAA SGFTFD | 450 | DYAMS | 725 | WVRQAPGK GLEWVS | 1000 | SINWSGTHTGY TDSVKG | 1275 |

TABLE A-1 -continued

Preferred combinations of CDR sequences, preferred combinations of framework sequences, and preferred combinations of framework and CDR sequences.
("ID" refers to the SEQ ID NO in the attached sequence listing)

| Name | FR1 ID | FR1 Seq | CDR1 ID | CDR1 Seq | FR2 ID | FR2 Seq | CDR2 ID | CDR2 Seq | ID |
|---|---|---|---|---|---|---|---|---|---|
| 17E2 | 176 | EVQLVESGGSLVPPGGSLRLSCAASGFTFD | 451 | DYGMS | 726 | WVRQAPGKGLEWVS | 1001 | SINWSGTHTDYTDSVKG | 1276 |
| 2B1 | 177 | EVQLVESGGSLVQPGGSLRLSCAASGFTFD | 452 | DYAMT | 727 | WVRQAPGKGLEWVS | 1002 | SINWSGTHTDYTDSVKG | 1277 |
| 2A5 | 178 | EVQLVESGGGLVQPGGSLRLSCATSGFTFD | 453 | DYAMT | 728 | WVRQAPGKGLEWVS | 1003 | SINWSGTHTDYTDSVKG | 1278 |
| 13C12 | 179 | EVQLVESGGSLVQPGGSLRLSCATSGFTFD | 454 | DYAMT | 729 | WVRQAPGKGLEWVS | 1004 | SINWSGTHTDYTDSVKG | 1279 |
| 17E10 | 180 | EVQLVESGGSLVQPGGSLRLSCAASGFTFD | 455 | DYAMT | 730 | WVRQAPGKGLEWVS | 1005 | SINWSGTHTDCTDSVKG | 1280 |
| 27D4 | 181 | EVQLVESGGSLVQPGGSLRLSCAASGFTFD | 456 | DYAMT | 731 | WVRQASGKGLEWVS | 1006 | SINWSGTHTDYADSVKG | 1281 |
| 15F9 | 182 | EVQLVESGGSLVQPGGSLRLSCAASGFTFD | 457 | DYAMT | 732 | WVRQAPGKGLEWVS | 1007 | SINWSGTHTDYTGSVKG | 1282 |
| 30H9 | 183 | EVQLVESGGSLVQPGGSLRLSCAASGFTFD | 458 | DYAMT | 733 | WVRQAPGKGLEWVS | 1008 | SINWSGTHTDYTDSVKG | 1283 |
| 39C1 | 184 | EVQLVESGGSLVPPGGSLRLSCAASGFTFD | 459 | DYGMS | 734 | WVRQAPGKGLEWVS | 1009 | SINWSGTHTDYTDSVKG | 1284 |
| 27G2 | 185 | EVQLVESGGSLVQPGGSLRLSCAASGFTFD | 460 | DYAMT | 735 | WVRQTPGKGLEWVS | 1010 | SINWSGTHTDYTDSVKG | 1285 |
| 2D3 | 186 | EVQLVESGGSLVQPGGSLRLSCAASGFTFD | 461 | DYAMS | 736 | WVRQVPGKGLEWVS | 1011 | SINWSGTHTDYADSVKG | 1286 |
| 5F7 | 187 | EVQLVESGGGLVQAGGSLRLSCAASGITFS | 462 | INTMG | 737 | WYRQAPGKQRELVA | 1012 | LISSIGDTYYADSVKG | 1287 |
| 118N121_A1_4_OK/1-127 | 188 | EVQLVESGGGFVQTGGSPRLSCAASGRSFS | 463 | EYAAA | 738 | WFRQSPGKERDLVA | 1013 | GIMWDGRSLFYADSVKG | 1288 |
| 47D5 | 189 | KVQLVESGGGLVQPGGSLRLSCAASGSIFG | 464 | FNDMA | 739 | WYRQAPGKQRELVA | 1014 | LISRVGVTSSADSVKG | 1289 |
| 14B11 | 190 | EVQLVESGGGLVQAGGSLRLSCAASGSTFS | 465 | SYGMG | 740 | WFRQVPGKEREFVA | 1015 | TINWSGVTAYADSVKG | 1290 |
| 14B10 | 191 | EVQLVESGGGLVQAGGSLRLSCAVNSRTFS | 466 | SYGMG | 741 | WFRQAPGKEREFVA | 1016 | TINWSGVTAYADSIKG | 1291 |
| 14B4 | 192 | EVQLVESGGGLVQAGGSLRLSCAVSSRAFS | 467 | SYGMG | 742 | WFRQAPGKDREFVA | 1017 | TINWSGVTAYADSIKG | 1292 |
| 14C11 | 193 | EVQLVESGGGLVQAGGSLRLSCAVNSRTFS | 468 | SYGMG | 743 | WFRQAPGKEREFVA | 1018 | TINWSGATAYADSIKG | 1293 |

TABLE A-1 -continued

Preferred combinations of CDR sequences, preferred combinations of framework sequences, and preferred combinations of framework and CDR sequences.
("ID" refers to the SEQ ID NO in the attached sequence listing)

| | | | | | | | | | |
|---|---|---|---|---|---|---|---|---|---|
| 14B5 | 194 | EVQLVESGGGLV QAGGSLRLSCAV SSRAFS | 469 | SYGMG | 744 | WFRQAPGK DREFVA | 1019 | TINWSGVTAYA DSIKG | 1294 |
| 14C6 | 195 | EVQLVESGGGSV QAGGSLRLSCVA SEGTFS | 470 | SYGMG | 745 | WFRQAPGK ERAFVA | 1020 | TINWSGVTAYA DSVKG | 1295 |
| 14A4 | 196 | EVQLVESGGGSV QAGSSLTLSCVAS EGTFS | 471 | SYGMG | 746 | WFRQAPGK ERAFVA | 1021 | TINWSGVNAYA DSVKG | 1296 |
| 14B3 | 197 | EVQLVESGGGLV QPGGSLTLSCVA SEGTFS | 472 | SYGMG | 747 | WFRQAPGK ERAFVA | 1022 | TINWSGVNAYA DSVKG | 1297 |
| 14C1 | 198 | EVQLVESGGGSV QAGGSLRLSCAA SGSTFS | 473 | SYGMG | 748 | WFRQAPGK ERAFVA | 1023 | TINWSGVTAYA DSVKG | 1298 |
| 14A12 | 199 | EVQLVKSGGGLV QAGGSLRLSCAA SERTFS | 474 | SYGMG | 749 | WFRQAPGK EREFVA | 1024 | TINWSGVTAYA DSVKG | 1299 |
| 14A2 | 200 | EVQLVESGGGLV QAGGSLRLSCAA SERTFS | 475 | SYGMG | 750 | WFRQAPGK EREFVA | 1025 | TINWSGVTAYA DSVKG | 1300 |
| 14A1 | 201 | EVQLVESGGGSV QAGGSLRLSCAA SERTFS | 476 | SYGMG | 751 | WFRQAPGK EREFVA | 1026 | TINWSGVTAYA DSVKG | 1301 |
| 17C3 | 202 | EVQLVESGGGLV QAGGSLRLSCAA NGLTFR | 477 | RYDMG | 752 | WYRQAPGQ QREWVA | 1027 | AISGAGDINYA DSVKG | 1302 |
| 46D3 | 203 | KVQLVESGGGLV QAGGSLRLSCAA SGRTFT | 478 | EYSMG | 753 | WFRQAPGK EREFVA | 1028 | TISWNYGYTYY SDSVKG | 1303 |
| 27H5 | 204 | EVQLVESGGGLV QAGGSLRLSCAA SGFTFD | 479 | DYGIG | 754 | WFRQASGK EREGVS | 1029 | CITSSDGSTYY ADSVKG | 1304 |
| 17C2 | 205 | EVQLVESGGGLV QPGGSLRLSCAA SGFAFS | 480 | SYAMS | 755 | WVRQAPGK GLEWVS | 1030 | AVDSGGGRTD YAHSVKG | 1305 |
| 17D11 | 206 | EVQLVESGGGLV QAGGSLRLSCTA SGRTSS | 481 | TSAMG | 756 | WFRQAPGK EREFVA | 1031 | TISRGGSATYY ADSLKG | 1306 |
| 15A6 | 207 | EVQLVESGGGLV QAGGSLRLSCVT SRRPAS | 482 | TRTMA | 757 | WYRQAPGK QRDWVA | 1032 | TISSHGLPVYA DSVKG | 1307 |
| 17B6 | 208 | EVQLVESGGGLV QPGGSLRLSCAA SRIPFS | 483 | TRTMA | 758 | WYRQAPGK QRDWVA | 1033 | TIGTSGPPRYA DSVKG | 1308 |
| 17C5 | 209 | EVQLVESGGGLV QAGGSLRLSCVT SRRPAS | 484 | TRTMA | 759 | WYRQAPGK QRDWVA | 1034 | TISSHGLPVYA DSVKG | 1309 |
| 15E11 | 210 | EVQLVESGGGLV QAGGSLRLSCVA SRIPFS | 485 | SRTMA | 760 | WYRQAPGK QRDWVA | 1035 | TISARGMPAYE DSVKG | 1310 |
| 15C2 | 211 | EVQLVESGGGLV QAGGSLRLSCVT SRRPAS | 486 | TRTMA | 761 | WYRQAQGK QRDWVA | 1036 | TISSHGLPVYA DSVKG | 1311 |

TABLE A-1 -continued

Preferred combinations of CDR sequences, preferred combinations of framework sequences, and preferred combinations of framework and CDR sequences.
("ID" refers to the SEQ ID NO in the attached sequence listing)

| Clone | ID | FR1 | ID | CDR1 | ID | FR2-CDR2 | ID | FR3 | ID |
|---|---|---|---|---|---|---|---|---|---|
| 2A3 | 212 | EVQLVESGGGLVQAGGSLNLSCVASGIPFS | 487 | TRTMA | 762 | WYRQAPGKPRDWVA | 1037 | TIRNGAPVYADSVKG | 1312 |
| 27A5 | 213 | EVQLVESGGGLVQAGGSLNLSCVASGIPFS | 488 | TRTMA | 763 | WYRQPPGNERDWVA | 1038 | TIRSGAPVYADSVKG | 1313 |
| 2C5 | 214 | EVQLVESGGGLVQAGGSLNLSCVASGIPFS | 489 | TRTMA | 764 | WYRQTPGKSRDWVA | 1039 | TIRSGTPVYADSVKG | 1314 |
| 27G5 | 215 | EVQLVESGGGLVQPGGSLRLSCVASRIPAS | 490 | IRTMA | 765 | WYRQTPGNQRDWLA | 1040 | TIGSSGTPAYADSVKG | 1315 |
| 13A9 | 216 | EVQLVESGGGLVQAGGSLRLSCVASRIPAS | 491 | IRTMA | 766 | WYRQAPGKQRDWVA | 1041 | TIGTGGTPAYADSFKG | 1316 |
| 29E9 | 217 | EVQLVESGGGLVQPGGSLRLSCVASRIPAS | 492 | IRTMA | 767 | WYRQTPGNQRDWLA | 1042 | TIGSSGTPAYADSVKG | 1317 |
| 15D8 | 218 | EVQLVESGGGLVQPGGSLKLSCVASTIPAS | 493 | IRTMA | 768 | WYRQTPGNQRDWLA | 1043 | TIGSSGTPAYADSVKG | 1318 |
| 15G4 | 219 | EVQLVESGGGLVQAGGSLRLSCVASGIPFR | 494 | SRTMA | 769 | WYRQAPGKTRDWVA | 1044 | TIGTHGTPLYADSVKG | 1319 |
| 15D12 | 220 | EVQLVESGGGLVQAGESLRLSCATSGITFK | 495 | RYVMG | 770 | WYRQGPGKQRELVA | 1045 | TVNDGGTTSYADSVKG | 1320 |
| 15E12 | 221 | EVQLMESGGGLVQAGGSLRLSCAANGLTFR | 496 | RYDMG | 771 | WYRQAPGQQREWVA | 1046 | AISGAGDINYADSVKG | 1321 |
| 13D7 | 222 | EVQLVESGGGLVQAGGSLRLSCAANGLTFR | 497 | RYDMG | 772 | WYRQAPGQQREWVA | 1047 | AISGAGDINYADSVKG | 1322 |
| 13A8 | 223 | EVQLVESGGGLVQPGGSLRLSCAASGLGIA | 498 | FSRRTMA | 773 | WYRQAPGKQRDWVA | 1048 | TIAGDGSTVYADSMKG | 1323 |
| 15A4 | 224 | EVQLVESGGGLVQPGGSLRLSCAASGLGIA | 499 | FSRRTMA | 774 | WYRQAPGKQRDWVA | 1049 | TIAGDGSTVYADSMKG | 1324 |
| 17F7 | 225 | EVQLVESGGGLVQAGGSLRLSCVASGIAQS | 500 | IRVMA | 775 | WYRQPPGKQRDWVG | 1050 | TISSDGTANYADSVKG | 1325 |
| 15C8 | 226 | EVQLVESGGGLVQAGGSLRLSCAASGIAFR | 501 | IRTMA | 776 | WYRQAPGKQRDWVA | 1051 | TSDSGGTTLYADSVKG | 1326 |
| 17A10 | 227 | EVQLVESGGGLVQAGGSLRLSCVASGIPSI | 502 | RAIA | 777 | WYRQAPGKQRDWVA | 1052 | TSGTGYGATYDDSVKG | 1327 |
| 27D3 | 228 | EVQLMESGGGLVQPGGSLRLSCAASGLGIA | 503 | FSRRTMA | 778 | WYRQAPGKQRDWVA | 1053 | TIAGDGSTVYADSMKG | 1328 |
| 13B12 | 229 | EVQLVESGGGLVQAGGSLRLSCAASGIAFR | 504 | IRTMA | 779 | WYRQAPGKQRDWVA | 1054 | TIGSDGTTJYADSVKG | 1329 |

TABLE A-1 -continued

Preferred combinations of CDR sequences, preferred combinations of framework sequences, and preferred combinations of framework and CDR sequences.
("ID" refers to the SEQ ID NO in the attached sequence listing)

| | | | | | | | |
|---|---|---|---|---|---|---|---|
| 15B2 | 230 | EVQLVESGGGLV QAGGSLRLSCVV SGIPSS | 505 | IRAMA | 780 | WYRQAPGR QRDWVA | 1055 | TIYSPSGSAVY ADSVKG | 1330 |
| 15B11 | 231 | EVQLVESGGGSV QAGGSLRLSCVV SGIPSS | 506 | IRAMA | 781 | WYRQAPGR QRDWVA | 1056 | TIYSRSGGAVY ADSVKG | 1331 |
| 13C9 | 232 | EVQLVESGGGLV QAGGSLRLSCVA SGIPSI | 507 | HAMA | 782 | WYRQAPGK QRDWGA | 1057 | TTYSRGGTTYN DSAKG | 1332 |
| 17D5 | 233 | EVQLVESGGGLV QPGGSLRLSCAA SGIIGT | 508 | IRTMA | 783 | WYRQAPGK QRDWVA | 1058 | SIGTRGAPVYA DSVNG | 1333 |
| 27B5 | 234 | EVQLVESGGGLV QAGGSLRLPCAA SGIAFR | 509 | IRTMA | 784 | WYRQAPGK QRDWVA | 1059 | TSDSGGTTLYA DSVKG | 1334 |
| 27C7 | 235 | EVQLVESGGGLV QAGGSLRLSCAA SGIAFR | 510 | IRTMA | 785 | WYRQAPGK QRDWVA | 1060 | TSDSGGTTLYA DSVKG | 1335 |
| 13D4 | 236 | EVQLVESGGGLV QAGGSLRLSCVV SGIPSS | 511 | IRAMA | 786 | WYRQAPGR QRDWVA | 1061 | TIYSPSGSAVY ADSVKG | 1336 |
| 15G5 | 237 | EVQLVESGGGLV QAGGSLRLSCVV SGIPST | 512 | IRAMA | 787 | WYRQAPGR QRDWVA | 1062 | TIYSPSGSAVY ADSVKG | 1337 |
| 13C4 | 238 | EVQLVESGGGLV QAGGSLRLSCVV SGIPSS | 513 | IRAMA | 788 | WYRQAPGR QRDWVA | 1063 | TIYSPSGSAVY ADSVKG | 1338 |
| 46G1 | 239 | EVQLVESGGGLV QAGGSLRLSCAA SGRTFS | 514 | DDAMG | 789 | WFRQAPGK ERECVA | 1064 | SLYLNGDYPYY ADSVKG | 1339 |
| 46E4 | 240 | EVQLVESGGGLV QAGGSLRLSCAA SGRAFK | 515 | DDAVG | 790 | WFRQAPGK ERECVA | 1065 | SMYLDGDYPY YADSVKG | 1340 |
| 17B5 | 241 | EVQLVESGGGLV QTGGSLRLSCAA SGSTFR | 516 | TDMMG | 791 | WYRQAPGK QREFVA | 1066 | SITKFGSTNYA DSVKG | 1341 |
| 15C9 | 242 | EVQLVESGGGLV QAGGSLKLSCVN SGIPST | 517 | LRAMA | 792 | WYRQAPGR QRDWVA | 1067 | TSSNTGGTTYD DSVKG | 1342 |
| 13D10 | 243 | EVQLVESGGGLV QPGGSLRLSCAA SSVITL | 518 | DSNAIG | 793 | WFRQAPGK EREEVS | 1068 | CIASSDGSTYY AESVKG | 1343 |
| 17C6 | 244 | EVQLVESGGGLV QAGGSLTLSCAA SGSTSS | 519 | LDIMA | 794 | WYRQAPEK QRELVA | 1069 | SVSGGGNSDY ASSVKG | 1344 |
| 15A2 | 245 | EVQLVESGGGLA QAGGSLSLSCAA SGRFFS | 520 | TRVMA | 795 | WYRQTPGK QREFVA | 1070 | SMRGSGSTNY ADSARG | 1345 |
| 17A8 | 246 | EVQLVESGGGLV QAGGSLSLSCAA SGRFFS | 521 | TRVMA | 796 | WYRQTPGK QREFVA | 1071 | SMRGSGSTNY ADSVRG | 1346 |
| 15G10 | 247 | EVQLVESGGGLV QAGGSLSLSCAA SGRFFS | 522 | TRVMA | 797 | WYRQTPGK QREFVA | 1072 | SMRGSGSTNY ADSARG | 1347 |

TABLE A-1 -continued

Preferred combinations of CDR sequences, preferred combinations of framework sequences, and preferred combinations of framework and CDR sequences.
("ID" refers to the SEQ ID NO in the attached sequence listing)

| | | | | | | | |
|---|---|---|---|---|---|---|---|
| 27A3 | 248 | EVQLVESGGGLV QAGGSLSLSCVA SGRFFS | 523 | TRVMA | 796 | WYRQTPGK QREFVA | 1073 | SMRGSGSTNY ADSVRG | 1348 |
| 17H10 | 249 | EVQLVESGGGLV QAGGSLSLSCSA SGRFFS | 524 | TRVMA | 799 | WYRQTPGN QREFVA | 1074 | TIHSSGSTIYAD SVRG | 1349 |
| 30D10 | 250 | EVQLVESGGGLV QAGGSLTLSCTAS ETTVR | 525 | IRTMA | 800 | WYRQPPGN QREWVA | 1075 | TIGSNGFATYP DSVKG | 1350 |
| 15H4 | 251 | EVQLVESGGGLV QAGGSLTLSCAP SESTVS | 526 | FNTVA | 801 | WYRQAPGE QREWVA | 1076 | TISRQGMSTYP DSVKG | 1351 |
| 17B7 | 252 | EVQLVESGGGLV QAGGSLRLSCAA SGIISS | 527 | FRTMA | 802 | WYRQAPGK QREWVA | 1077 | TIGSDGLANYA DSVKG | 1352 |
| 15D2 | 253 | EVQLVESGGGLV QAGGSLRLSCVV SGVFGP | 528 | IRAMA | 803 | WYRQAPGK QRDWVA | 1078 | TIGSSGHPVYT DSVKG | 1353 |
| 17G5 | 254 | EVQLVESGGGLV QPGGSLRLSCAA SGIGIA | 529 | FSSRTMA | 804 | WYRQAPGK QRDWVA | 1079 | TIGSGGTTNYA DSVKG | 1354 |
| 15B6 | 255 | EVQLVESGGGLV QPGGSLRLSCAA SGIIGS | 530 | FRTMA | 805 | WYRQAPGN QRDWVA | 1080 | TIGSAGLASYA DSVRG | 1355 |
| 27F2 | 256 | EVQLVESGGGLV QAGGSLRLSCAA SGIISS | 531 | FRTLA | 806 | WYRQAPGK QRDWVA | 1081 | TISSAGGTAYA DAVKG | 1356 |
| 17F5 | 257 | EVQLVESGGGLV QPGGSLRLSCAA SGLGIA | 532 | FSRRTMA | 807 | WYRQAPGK QRDWVA | 1082 | TIAGDGSTVYA DSMKG | 1357 |
| 17B2 | 258 | EVQLVESGGGLV QPGGSLRLSCAG SGFTFS | 533 | NYAMT | 808 | WVRQAPGK GLEWVS | 1083 | GVGGDGVGSY ADSVKG | 1358 |
| 27H4 | 259 | EVQLVESGGGLV QAGGSLRLSCVA SKMTFM | 534 | RYTMG | 809 | WYRQAPGK QRDLVA | 1084 | SIDASGGTNYA DSVKG | 1359 |
| 13A4 | 260 | EVQLVESGGGLV QAGGSLRLSCVA SKMTFM | 535 | RYTMG | 810 | WYRQAPGK QRDLVA | 1085 | SIDSSGGTNYA DSVKG | 1360 |
| 2A1 | 261 | EVQLVESGGGLV QAGGSLRLSCVA SKITFR | 536 | RYIMD | 811 | WYRQAPGK QRELVA | 1086 | SINSDGSTGYT DSVKG | 1361 |
| 15E10 | 262 | EVQLVESGGGLV QAGGSLKLSCVA SGITFF | 537 | RYTMG | 812 | WYRQAPGK ERELVA | 1087 | EISSADEPSFA DAVKG | 1362 |
| 27E7 | 263 | EVQLVESGGGLV QAGGSLRLSCAA SGITFR | 538 | RYDMG | 813 | WYRQFPGK ERELVA | 1088 | TILSEGDTNYV DPVKG | 1363 |
| 47E5 | 264 | EVQLVESGGGLV QAGGSLRLSCAA SASIFG | 539 | FDSMG | 814 | WYRQAPGN ERILVA | 1089 | IISNGGTTSYR DSVKG | 1364 |
| 2G4 | 265 | EVQLVESGGGLV QAGGSLRLSCAA SGNIFS | 540 | HNAMG | 815 | WYRQAPGK QRELVT | 1090 | YITINGIANYVD SVKG | 1365 |

TABLE A-1 -continued

Preferred combinations of CDR sequences, preferred combinations of framework sequences, and preferred combinations of framework and CDR sequences.
("ID" refers to the SEQ ID NO in the attached sequence listing)

| | | | | | | | |
|---|---|---|---|---|---|---|---|
| 14D4 | 266 | EVQLVESGGGLVQAGDSLRLSCAASGRALD | 541 | TYVMG | 816 | WFRQAPGDGREFVA | 1091 | HIFRSGITSYASSVKG | 1366 |
| 17A5 | 267 | EVQLVESGGGLVQPGGSLRLSCAASGFTFD | 542 | DYSMS | 817 | WVRQATGKGLEWVS | 1092 | GISWNGGSTNYADSVKG | 1367 |
| 15D10 | 268 | EVQLVESGGGLVQPGGSLKLSCAASGFTFS | 543 | SYRMY | 818 | WVRQAPGKGLEWVS | 1093 | AIKPDGSITYYADSVKG | 1368 |
| 13C2 | 269 | EVQLVESGGGLVQAGGSLRLSCAASGSTFS | 544 | INRMA | 819 | WYRQSPGKQRELVA | 1094 | AVDNDDNTEYSDSVAG | 1369 |
| 17G11 | 270 | EVQLVESGGGLVQAGGSLRLSCAASGSTFS | 545 | INRWG | 820 | WYRQAPGKQRELVA | 1095 | AIDDGGNTEYSDFVNG | 1370 |
| 17A3 | 271 | EVQLVESGGGLVQAGGSLSLSCAASATLHR | 546 | FDNN | 821 | WYRQAPGKQRELVA | 1096 | TIAHDGSTNYANSVKG | 1371 |
| 27B7 | 272 | EVQLVESGGGLVQPGGSLRLSCAASGFTFS | 547 | SYAMS | 822 | WVRQAPGKGLEWVS | 1097 | AISSGGGSITTYADSVKG | 1372 |
| 17A6 | 273 | EVQLVESGGGLVQPGGSLRLSCAASGFTFS | 548 | SYAMS | 823 | WVRQAPGKGLEWVS | 1098 | AISSGGGSITTYADSVKG | 1373 |
| 17D7 | 274 | EVQLVESGGGLVQPGGSLRLSCAASGFTLD | 549 | YCAIG | 824 | WFRQAPGKEREGVS | 1099 | CISSSDGSTYYADSVKG | 1374 |
| 46D4 | 275 | EVQLVESGGGLVQPGGSLRLSCAASGFIFD | 550 | DYAMS | 825 | WVRQAPGKGLEWVS | 1100 | SINWSGTHTDYAEDMKG | 1375 |
| 27B3 | 276 | EVQLVESGGGLVQAGGSLTLSCTASETTVR | 551 | IRTMA | 826 | WYRQPPGNQREWVA | 1101 | TIGSNGFATYPDSVKG | 1376 |
| 27E5 | 277 | EVQLVESGGGLVQAGGSLTLSCTASETTVR | 552 | IRTMA | 827 | WYRQPPGNQREWVA | 1102 | TIGSNGFATYPDSVKG | 1377 |
| 27D6 | 278 | EVQLVESGGGLVQAGGSLTLSCTASETTVR | 553 | IRTMA | 828 | WYRQPPGNQREWVA | 1103 | TIGSNGFATYPDSVKG | 1378 |
| 30D10 | 279 | EVQLVESGGGLVQAGGSLTLSCTASETTVR | 554 | IRTMA | 829 | WYRQPPGNQREWVA | 1104 | TIGSNGFATYPDSVKG | 1379 |
| 47G11 | 280 | EVQLVESGGGLVQPGGSLRLSCAASGRIFY | 555 | PMG | 830 | WFRQAPGKEREFVA | 1105 | AIGSGDIITYYADSVKG | 1380 |
| 27C3 | 281 | EVQLVESGGGLVQPGGSLRLSCAASGFTFD | 556 | DYATS | 831 | WVRQAPGKGLEWVS | 1106 | AINSGGGSTYYADSVKG | 1381 |
| 11A101/1-120 | 282 | EVQLVESGGGLVQAGGSLRLSCAASGRTFN | 557 | AMG | 832 | WFRQAPGKEREFVA | 1107 | AISRSPGVTYYADSVKG | 1382 |
| 11A22/1-122 | 283 | EVQLVESGGGLVQAGGSLRLSCAASGRTFS | 558 | SYAMA | 833 | WFRQAPGTEREFIA | 1108 | GIRWSDGSTYYADSVKG | 1383 |

TABLE A-1 -continued

Preferred combinations of CDR sequences, preferred combinations of framework sequences, and preferred combinations of framework and CDR sequences.
("ID" refers to the SEQ ID NO in the attached sequence listing)

| | | | | | | | |
|---|---|---|---|---|---|---|---|
| 12D44/1-122 | 284 | KVQLVESGGGLVQAGGSLRLSCAASGRTFS | 559 | SYAMA | 834 | WFRQAPGTEREFIA | 1109 | GIRWSDGSTYYADSVKG | 1384 |
| 12E11/1-122 | 285 | EVQLVESGGGLVQAGGSLRLSCAASGRTFS | 560 | SYAMA | 835 | WFRQAPGKEREFVG | 1110 | GIRWSDGSTYYADSVKG | 1385 |
| 13G111/1-123 | 286 | EVQLVESGGGLVQAGGSLRLSCAASGRTFS | 561 | SYAMG | 836 | WFRQAPGKERAFVA | 1111 | AIRWSGGNTYYADSVKG | 1386 |
| 13F71/1-123 | 287 | EVQLVESGGGLVQAGGSLRLSCVASGRTFS | 562 | NYALA | 837 | WFRQAPGKEREFVA | 1112 | AINWRSGGSTYYADSVKG | 1387 |
| 14H61/1-122 | 288 | EVQLVESGGGLVQAGGSLRLSCAASGRTFS | 563 | RFAMG | 838 | WFRQAPGKEREFVA | 1113 | AVRWSDDYTYYADSVKG | 1388 |
| 22B12/1-124 | 289 | EVQLVESGGGLVQAGGSLRLSCAASGRTFS | 564 | SYAMA | 839 | WFRQAPGKEREFVA | 1114 | GINKSGGITHSADSVKG | 1389 |
| 14H71/1-123 | 290 | EVQLVESGGGLVQAGGSLRLSCEASGLTIS | 565 | SLTMA | 840 | WFRQAPGKEREFVA | 1115 | NIKWSGDRIVYADSVKG | 1390 |
| 12D51/1-120 | 291 | EVQLVESGGGLVQPGGSLRLSCAASGSAFS | 566 | IKSMG | 841 | WYFRQAPGKQRELAA | 1116 | VIISSGTTTYADSVKG | 1391 |
| 11A111/1-126 | 292 | EVQLVESGGGLVQAGGSLGLSCAAAGRTFS | 567 | SSLMG | 842 | WFRQAPGKEREFVA | 1117 | AITDNGGSTYYADSVKG | 1392 |
| 13G71/1-124 | 293 | EVQLVESGGGLVQAGGSLRLSCAASGRAFS | 568 | SYAMG | 843 | WFRQAPGKERDFVA | 1118 | AITSSGSTNYADSVKG | 1393 |
| 13G74/1-125 | 294 | EVQLVESGGGLVQAGGSLRLSCATSGRTFS | 569 | TYASMG | 844 | WFRQTPGKEREFVA | 1119 | AITSSGSTNYADSVKG | 1394 |
| 11A71A/1-116 | 295 | EVQLVESGGGLVQPGGSLRLSCAASGNIDG | 570 | IITMG | 845 | WYRQRPGKPREWVG | 1120 | TINSGGDTNYAGSVKG | 1395 |
| 22B101/1-123 | 296 | EVQLVESGGGLVQTGGSLRLSCAASGPTFS | 571 | DYAIG | 846 | WFRQAPGKEREFVA | 1121 | AISSSGISTIYGDSVKG | 1396 |
| 11B42/1-123 | 297 | EVQLVESGGGLVQAGDSLRLSCAASGFTFS | 572 | NHIMG | 847 | WFRQAPGKERELIA | 1122 | HITWNGGSTYYADSVKG | 1397 |
| 13E111/1-124 | 298 | EVQLVESGGGLVQAGSSLRLSCALSGRTFS | 573 | DYAIG | 848 | WFRQAPGKEREFVA | 1123 | AISGWSGGTTNYADSVKG | 1398 |
| 14H12/1-125 | 299 | EVQLVESGGGLVQAGGSLRLSCIASERTFS | 574 | SAGVG | 849 | WFRQAPGKERDFVA | 1124 | AISWNGVTIYYADSVKG | 1399 |
| 13G101/1-123 | 300 | EVQLVESGGGLVQPGDSLRLSCSASEGTLS | 575 | RSRVA | 850 | WFRQAPGKEREFVT | 1125 | VISGVGTSYADSVKG | 1400 |
| 13G41/1-121 | 301 | EVQLVESGGGLVQPGGSLTLSCVGSGRRFS | 576 | ADVMG | 851 | WYRQAPGKQREFVA | 1126 | SISSGSAINYADSVKG | 1401 |

TABLE A-1 -continued

Preferred combinations of CDR sequences, preferred combinations of framework sequences, and preferred combinations of framework and CDR sequences.
("ID" refers to the SEQ ID NO in the attached sequence listing)

| | | | | | | | | | |
|---|---|---|---|---|---|---|---|---|---|
| 22B910/1-121 | 302 | EVQLVESGGGLVQPGGSLPLSCAASGSIFR | 577 | MNDMG | 852 | WYRQAPGKORERVA | 1127 | TLTSAGNTNYADSVKG | 1402 |
| 21A81/1-122 | 303 | EVQLVESGGGLAQAGGSLRLSCAVFGRSRY | 578 | GMA | 853 | WFRRAPGKEREFVA | 1128 | GIAWNGASIGSADSVRG | 1403 |
| 21A92/1-127 | 304 | EVQLVESGGGQVQAGGSLRLSCTESGRAFN | 579 | TRAMG | 854 | WFRQAPEKEREFVA | 1129 | GITMSGFNTRYADSVKG | 1404 |
| 22C712/1-123 | 305 | EVQLVESGGGLVQAGGSLGLSCAASGRTFS | 580 | NYAMG | 855 | WFRQAPGKEREFVA | 1130 | GISWSGGHTFYADSVKG | 1405 |
| 11A13/1-125 | 306 | EVQLVESGGGLVQAGDSLRLSCVASGGTFG | 581 | SYAMG | 856 | WFRQAPGKEREFVA | 1131 | TIDWSGDTAFYADSVKG | 1406 |
| 13G93/1-123 | 307 | EVQLVESGGGLAQAGDSLRLSCVDSGSSFS | 582 | AYAMG | 857 | WFRQAPGKEREFVA | 1132 | AVSWDGRNTYYADSVKG | 1407 |
| 12C52/1-118 | 308 | EVQLVESGGGLVQAGGSLRLSCAVSGGTFE | 583 | SDTMA | 858 | WFRQAPGKEREFVA | 1133 | RVSWIRTTYYSDSVKG | 1408 |
| 12C61/1-126 | 309 | EVQLVESGGGLVQAGGSLRLSCAASGRTFS | 584 | SNAMA | 859 | WFRQAPGNERELVS | 1134 | AIGWSGASTYYIDSVEG | 1409 |
| 21A61/1-125 | 310 | EVQLVESGGGLVQAGDSLRLSCVASGDSFN | 585 | TYTMG | 860 | WFRQAPGKEREFVA | 1135 | AIRWSGGTTFYGDSVKG | 1410 |
| 11A121/1-126 | 311 | EVQLVESGGGLVQAGGSLRLSCVVSEGTFS | 586 | SYSMG | 861 | WFRQAPGKDREFVS | 1136 | AITWNGTRTYYRDSVKG | 1411 |
| 11A91/1-124 | 312 | EAQLVESGGGLVQAGGSLRLSCTASGRTYS | 587 | TTMG | 862 | WFRQAPGKEREFVA | 1137 | AIRWSGGSAFYADSVKG | 1412 |
| 13G72/1-118 | 313 | EVQLVESGGGLVQAGGSLRLSCAASGRAFS | 588 | SYAMG | 863 | WFRQAPGKERDFVA | 1138 | AITSSGSTNYADSVKG | 1413 |
| 13E81/1-124 | 314 | EVQLVESGGGLVQAGGSLRLSCAASGGTFS | 589 | VYHMA | 864 | WFRQAPGKEREFVA | 1139 | AIRSSGGLFYALSVSG | 1414 |
| 11B31/1-124 | 315 | EVQLVESGGGLVQAGGSLRLSCAASGGAFG | 590 | VYHMG | 865 | WFRQAPGKEREFVA | 1140 | AIRSGGTTLYEDSVKG | 1415 |
| 13G81/1-124 | 316 | EVQLVESGGGLVQAGGSLRLSCAASGGTFG | 591 | VYHMG | 866 | WFRQAPGKEREFVA | 1141 | VIRSGGTTLYADSVKG | 1416 |
| 21A53/1-124 | 317 | EVQLVESGGGLVQAGGSLELSCAASGGAFG | 592 | VYHMG | 867 | WFRQAPGKEREFVA | 1142 | AIRSGGTTLYEDSVKG | 1417 |
| 14H51/1-124 | 318 | EVQLVESGGGLVQAGGSLRLSCAASGGTFG | 593 | VYTMA | 868 | WFRQAPGKEREFVA | 1143 | AIRSGATTLYEDSVKG | 1418 |
| 21A21/1-124 | 319 | EVQLVESGGGLVQAGGSLRLSCAASGGTFG | 594 | VYHMG | 869 | WFRQAPGTEREFVA | 1144 | VIRSGGTTLYEDSVKG | 1419 |

TABLE A-1 -continued

Preferred combinations of CDR sequences, preferred combinations of framework sequences, and preferred combinations of framework and CDR sequences.
("ID" refers to the SEQ ID NO in the attached sequence listing)

| | | | | | | | |
|---|---|---|---|---|---|---|---|
| 21A111/1-124 | 320 | EVQLVESGGGLV QAGGSLKLSCAV SGRTIV | 595 | PYTMA | 870 | WFRQAPGK EREFVA | 1145 | VTRSGGTTFYA DSAKG | 1420 |
| 22B1212/1-122 | 321 | EVQLVESGGGLV QPGGSLRLSCAA SGFTFS | 596 | SYAMS | 871 | WVRQAPGK GLEWVS | 1146 | AINSGGGSTSY ADSVKG | 1421 |
| 11A31/1-120 | 322 | EVQLVESGGGLV QAGGSLRLSCAA SGGTFS | 597 | SGVMA | 872 | WFRQSPGE EREFLA | 1147 | LITRNGETKKT ADSVKG | 1422 |
| 13E51/1-128 | 323 | EVQLVESGGGLV QAGGSLRLSCAA SRHTFS | 598 | GYAMG | 873 | WFRQAPGK EREFVA | 1148 | AIRWSGGITYY ADSVKG | 1423 |
| 12D121/1-126 | 324 | EVQLVESGGGLV QTGGSLRLSCAA SGRAFS | 599 | TYGMG | 874 | WFRQAPGK AREFVA | 1149 | AISRSGTGTYY AGSMKG | 1424 |
| 13F121/1-119 | 325 | EVQLVESGGGLV QAGGSLRLSCAA SGRSFN | 600 | DYTMG | 875 | WFRQTPGK EREFVA | 1150 | RVWWNGGSA YYADSVKG | 1425 |
| 13G121/1-127 | 326 | EVQLVESGGGLV RAGTSLRLSCADS ARTFS | 601 | SAAMG | 876 | WFRQAPGK EREFVS | 1151 | AISPIGSSKYYA DSVKG | 1426 |
| 22B41/1-124 | 327 | EVQLVESGGGLV QPGGSLRLSCTV FGRTFS | 602 | GDVIG | 877 | WFRQAPGK EREFVA | 1152 | AISTSGGGTDS ADSVKG | 1427 |
| 12D71/1-125 | 328 | EVQLVESGGGLV QAGGSLGLSCAA SGRTVS | 603 | TMG | 878 | WFRQAPGK EREFVT | 1153 | AITWSGDSTNF ADSVKG | 1428 |
| 13F42/1-111 | 329 | EVQLVESGGGLV QAGGSLRLSCVA SGRTLS | 604 | TTGVG | 879 | WFRQAPGK GRESVA | 1154 | TIFVGGTTYYS DSVKG | 1429 |
| 12C101/1-111 | 330 | EVQLVESGGGLV QAGGSLRLSCVA SGRTLS | 605 | TTGVG | 880 | WFRQAPGK ERESVA | 1155 | TIFVGGTTYYS DSVKG | 1430 |
| 14H91/1-127 | 331 | EVQLVESGGGLV QAGGSLRLSCAA SGRTFS | 606 | RDVMG | 881 | WFRQAPGK EREFVA | 1156 | AKTWSGASTY YADSVRG | 1431 |
| 13F41/1-111 | 332 | EVQLVESGGGLV QAGGSLRLSCVA SGRTLS | 607 | TTGVG | 882 | WFRQAPGK ERESVA | 1157 | TIFVGGTTYYS DSVKG | 1432 |
| 14H21/1-125 | 333 | EVQLVESGGGLV QAGGSLRLSCVR SGGYFG | 608 | SYHIG | 883 | WFRQAPGN EREFVA | 1158 | AITWNGASTSY ADSVKG | 1433 |
| 22B610/1-120 | 334 | EVQLVESGGGLV QPGGSLRLSCAA SGSIFS | 609 | INAMG | 884 | WYRPAPGK QRELVA | 1159 | RITSTGSTNYA DSVKG | 1434 |
| 12C32/1-127 | 335 | EMQLVESGGGLV QAGGSLRLSCAT SERTFS | 610 | TYTMA | 885 | WFRQAPGK EREFVV | 1160 | AIKSSDNSTSY RDSVKG | 1435 |
| 12D61/1-116 | 336 | EVQLVESGGGLV QPGGSLRLSCAA SRSIFS | 611 | PNVVG | 886 | WYRPAPGK QRELVA | 1161 | AVTSGGITNYA DSVKG | 1436 |
| 13G31/1-125 | 337 | EVQLVESGGGLV QAGGSLRLSCAA SGGTFS | 612 | RYKMG | 887 | WFRQAPGK EREFVA | 1162 | ASRWSGGIKY HADSVKG | 1437 |

TABLE A-1 -continued

Preferred combinations of CDR sequences, preferred combinations of framework sequences, and preferred combinations of framework and CDR sequences.
("ID" refers to the SEQ ID NO in the attached sequence listing)

| | | | | | | |
|---|---|---|---|---|---|---|
| 22C65/1-124 | 338 | EVQLVESGGGLV QAGGSLRLSCAV SGFLFD | 613 SYAMG | 886 WFRQAPGK EREFVA | 1163 AIRWSGSATDY SDSVKG | 1438 |
| 11A71/1-125 | 339 | EVQLVESGGGLV QPGGSLRLSCAA SRSIRS | 614 VSVMG | 889 WYRLAPGN QRELVA | 1164 TITADGITNYAD SVKG | 1439 |
| 11B91/1-125 | 340 | EVQLVESGGALV QPGGSLRLSCAA SGSIRS | 615 INTMG | 890 WYRQAPGN QREFVA | 1165 AVTEGGTTSYA ASVKG | 1440 |
| 11A81/1-125 | 341 | EVQLVESGGALV QPGGSLRLSCAA SDSIRS | 616 INIMG | 891 WYRQAPGK QREFVA | 1166 AVTEDGSINYA ESVKG | 1441 |
| 11B121/1-127 | 342 | EVQLVESGGGLV QPGGSLRLSCAA SGSSAS | 617 INTMG | 892 WYRQAPGE QRELVA | 1167 EITEGGIINYTD SVKG | 1442 |
| 12D31/1-115 | 343 | EVQLVESGGGLV QPGGSLRLSCAA SRNIFD | 618 FNDMG | 893 WYRQGPGK EREFVA | 1168 LINVGGVAKYE DSVKG | 1443 |
| 11B51/1-127 | 344 | EVQLVESGGGLV QAGGSLRLSCAA SGGTFS | 619 GRGMG | 894 WFRQAPGK EREFVA | 1169 AVSWSGGNTY YADSVKG | 1444 |
| 13G51/1-127 | 345 | EVQLVESGGGLV QAGGSLSLSCAA SGGTFN | 620 GRAVG | 895 WFRQAPGE EREFVT | 1170 GISWSGGSTD YADSVKG | 1445 |
| 13F82A/1-130 | 346 | EVQLVESGGGLV QAGGSLRLSCAIS GRTLS | 621 GRAMG | 896 WFRQAPGK EREFRE | 1171 FVAATSWSGG SKYVADSVTG | 1446 |
| 13E101/1-128 | 347 | EVQLVESGGGLV QAGGSLRLSCAV SGRTFN | 622 NDHMG | 897 WFRQAPGT ERELVA | 1172 ATGRRGGPTY YADSVKG | 1447 |
| 22B85/1-120 | 348 | EVQLVESGGGLV RPGGSLRLSCAT SGSDIG | 623 INAMG | 898 WYRQAPGN QRELVA | 1173 TITGSTGTTYA DSVKG | 1448 |
| 11B12/1-118 | 349 | EVQLVESGGGLV QAGGSLRLSCAA SGRALI | 624 NYAMG | 899 WFRQAPGK EREFVS | 1174 AINWSGSHTDY GDSVKG | 1449 |
| 13G61/1-118 | 350 | EVQLVESGGGVV QAGGSLRLSCAP SGRTFS | 625 SYVMG | 900 WVRQAPGK AREFVA | 1175 GITRNSGRTRY ADSVKG | 1450 |
| 14H41/1-118 | 351 | EVQLVESGGGLV QAGGSLRLSCAP SGRTFS | 626 SYVMG | 901 WVRQAPGK AREFVA | 1176 GITRNSIRTRYA DSVKG | 1451 |
| 11B81/1-126 | 352 | EVQLVESGGGLV QAGGSLRLSCAA SGRPVN | 627 NYIMG | 902 WFRQALGQ GREFVA | 1177 AINRNGATAAY ADSVKG | 1452 |
| 11C11/1-121 | 353 | EVQLVESGGGLV QAGGSLRLSCAA SGRTFS | 628 AYAMG | 903 WFRQAPGK ERESVA | 1178 TIRWTGGSSST SYADSVKG | 1453 |
| 12D92/1-123 | 354 | EVQLVESGGGLV QAGGSLRLSCAA SGRTYN | 629 MA | 904 WFRQAPGK EREFVA | 1179 AMNWSGGSTK YAESVKG | 1454 |
| 13E61/1-123 | 355 | EVQLVESGGGLV QAGGSLRLSCTA SGQTFN | 630 MG | 905 WFRQAPGK EREFVA | 1180 AISWSQYNTKY ADSVKG | 1455 |

TABLE A-1 -continued

Preferred combinations of CDR sequences, preferred combinations of framework sequences, and preferred combinations of framework and CDR sequences.
("ID" refers to the SEQ ID NO in the attached sequence listing)

| Clone | FR1 ID | FR1 | CDR1 ID | CDR1 | FR2 ID | FR2 | CDR2 ID | CDR2 | FR3 ID |
|---|---|---|---|---|---|---|---|---|---|
| 22B71/1-114 | 356 | EVQLVESGGAFVQPGGSLRLSCAASGSDVW | 631 | FNVMG | 906 | WYRQGPGQQLELVA | 1181 | SITYGGNINYGDPVKG | 1456 |
| 21A121/1-123 | 357 | EVQLVESGGGLVQAGGSLRLSCTASGRAFN | 632 | MG | 907 | WFRQAPGKEREFVA | 1182 | GVNWGGGSTKVADSVKE | 1457 |
| 13F101/1-124 | 358 | EVQLVESGGGLVQAGGSLRLSCQLSGGTVS | 633 | DLHMG | 908 | WFRQAPGKEREFVG | 1183 | FTRWPSITYIAEHVKG | 1458 |
| 11A43/1-123 | 359 | EVQLVESGGGLVQAGGSLRLSCAASGSIFR | 634 | VNHMG | 909 | WYRQAPGKQREFVA | 1184 | AITSDHITWYADAVKG | 1459 |
| 12C81/1-117 | 360 | EVQLVESGGGLVQPGGSLRLSCAGSGNIVR | 635 | DNTMA | 910 | WYRQAPGNQRDLVA | 1185 | TINVGGGTYYAGPVKG | 1460 |
| 11B21/1-124 | 361 | EVQLVESGGGLVQAGGSLRLSCAASGRTFS | 636 | MYLMG | 911 | WFRQAPGKEREFVS | 1186 | TINRRGGNTYYADSVKG | 1461 |
| 11B71/1-126 | 362 | EVQLVESGGGLVQAGGSLRLSCAASGRTFE | 637 | RYAMG | 912 | WFRQAPGKEREFVA | 1187 | TISWSGGRDTVYADSVKG | 1462 |
| 12C121/1-126 | 363 | EVQLVESGGDLVQPGESLRLSCAVSGVTVD | 638 | YSGIG | 913 | WFRQAPEKEREAVS | 1188 | CIESGDGTTTYVDSVKG | 1463 |
| 22C51/1-121 | 364 | EVQLVESGGGLVQAGASLRLSCAASGRTFS | 639 | RYDIG | 914 | WFRQAPGKGREFVA | 1189 | AINWSGGTTSFGDSVKG | 1464 |
| 12D11/1-123 | 365 | EVQLVESGGGLVQTGGSLRLSCAASGRTFS | 640 | GSRMG | 915 | WFRQAPGKEREFVA | 1190 | AIRWSGGITWYAESVKS | 1465 |
| 12D14/1-123 | 366 | EVQLVESGGGLVQAGGSLRLSCAASGRTFS | 641 | GSRMG | 916 | WLRQAPGKEREFVA | 1191 | AVRWSGGITWYAESVKG | 1466 |
| 12C111/1-123 | 367 | EVQLVESGGGLVQAGGSLRLSCAVSGLTFS | 642 | SYAMG | 917 | WFRQAPGKVREFVA | 1192 | TISRSGGRTSYADSVKG | 1467 |
| 22B55/1-123 | 368 | EVQLVESGGGLVQAGGSLRLSCAVSGLTFS | 643 | TYAMG | 918 | WFRQAPGKVREFVA | 1193 | TISRSGGRTSYADSVKG | 1468 |
| 14H121/1-113 | 369 | EVQLVESGGGLVQPGGSLRLSCAASGITFR | 644 | FKAMG | 919 | WFRQGPGKRRELVA | 1194 | RIAGGSTNYADSVKG | 1469 |
| 12C71/1-125 | 370 | EVQLVESGGGLVQAGGSLRLSCTASGGTFG | 645 | SYALG | 920 | WFRQSPGKERESVA | 1195 | AIDWDGSRTQYADSVKG | 1470 |
| 21A31/1-125 | 371 | EVQLVESGGGLVQAGGSLRLSCAASEPTFS | 646 | SVAMG | 921 | WFRQGPGKEREFAA | 1196 | TITWSGDSTYVTDSVKG | 1471 |
| 12C91/1-121 | 372 | EVQLVESGGGLVQAGGSLRLSCVASGRTSS | 647 | YYHMA | 922 | WFRQAPGKEREFIA | 1197 | AINLSSGSTYYPDSVKG | 1472 |
| 14H81/1-125 | 373 | EVQLVESGGGLVQAGGSLSLSCAASGRTFS | 648 | NYRMA | 923 | WFRQAPRKEREFVA | 1198 | AISRSGESTYFADSMKG | 1473 |

TABLE A-1 -continued

Preferred combinations of CDR sequences, preferred combinations of framework sequences, and preferred combinations of framework and CDR sequences.
("ID" refers to the SEQ ID NO in the attached sequence listing)

| | | | | | | | |
|---|---|---|---|---|---|---|---|
| 12C42/1-124 | 374 | EVQLVESGGGLVQAGGSLRLSCAASGRTFS | 649 | RYAMH | 924 | WFRQAPGSERDFVA | 1199 | GISWDGGSTFYANSVKG | 1474 |
| 12D102/1-118 | 375 | EVQLVESGGGLVQPGGSLRLSCAASGSSLS | 650 | FNAMG | 925 | WSREAPGKRRELVA | 1200 | RIISDDSTLYADSVKG | 1475 |
| 11A52/1-120 | 376 | EVQLVESGGGLVQAGGSLRLSCAASGRALS | 651 | NYAMR | 926 | WFRQAPGKEREFVA | 1201 | TINWSGSHTDYADSVKG | 1476 |
| 14H111/1-120 | 377 | EVQLVESGGGLVQAGGSLRLSCAASGRALI | 652 | SFAMR | 927 | WFRQAPGKEREFVA | 1202 | AINWSGTHTDYADSVKG | 1477 |
| 11B61/1-120 | 378 | EVQLVESGGGLVQAGGSLRLSCAASGRTSS | 653 | GYGMG | 928 | WFRQAPGKEREFVA | 1203 | AVGWYGSTYFADSVKG | 1478 |
| 12E42/1-118 | 379 | EVQLVESGGGLVQPGGSLRLSCAHSGRAFS | 654 | LRTMG | 929 | WYRQAPGNQRELVA | 1204 | LISAGDSTYYPDSVKG | 1479 |
| 13F81A/1-128 | 380 | EVQLVESGGGLVQAGGSLRLSCAASGRTFS | 655 | RYAMG | 930 | WFRQAPGKEREFVA | 1205 | AISWTGGSSYYGDSVKG | 1480 |
| 11B102/1-118 | 381 | EVQLVESGGGLVQAGGSLRLSCAASGGIFS | 656 | SHAIS | 931 | WFRQAPGKAREFVA | 1206 | AINWSGSHRDYADSAKG | 1481 |
| 21A41/1-120 | 382 | EVQLVESGGGLVQAGGSLRLSCAASGRIFS | 657 | NYAWS | 932 | WFRQAPGKERGFVA | 1207 | AINWSGGYTDYADSVKG | 1482 |
| 14H101/1-128 | 383 | EVQLVESGGGLVQAGGSLRLSCAASGRTFI | 658 | SSPMG | 933 | WFRQAPGKEREVVA | 1208 | ATTRSGGLPYYSDSVKG | 1483 |
| 12E21/1-115 | 384 | EVQLVESGGGLVQPGGSLRLSCAASGSIDS | 659 | IHVVG | 934 | WYRKAPGKQREVVA | 1209 | YIGTAGATHYADSVKG | 1484 |
| 13F21/1-123 | 385 | EVQLVESGGGLVQSGGSLRLSCVASGTIVS | 660 | INATS | 935 | WYRQAPGNQRELVA | 1210 | TIIGDGRTHYADSVKD | 1485 |
| 12E33/1-119 | 386 | EVQLVESGGGMVQAGGSLRLSCAASGLTLS | 661 | NYGMG | 936 | WFRQAPGKEREFVS | 1211 | SINWSGTHTYDADFVKG | 1486 |
| 13G11/1-122 | 387 | EVQLVESGGGLVQAGGSLRLSCAASGRTFI | 662 | SNYAMG | 937 | WFRQAPGKEREFVA | 1212 | TINWSGSHSDYADSVKG | 1487 |
| 118N121_A6_2_OK/1-123 | 388 | EVQLVESGGGLVQAGGSLRLSCVASGRTFS | 663 | GYSVG | 938 | WFRQSPGKEREFVG | 1213 | GINWSGRTYYVDSVKG | 1488 |
| 118N121_B8_1_OK/1-135 | 389 | EVQLVESGGGLVQDGGSLRLSCAASGQLAN | 664 | FASYAMG | 939 | WFRQAPGKAREFVA | 1214 | AIRGSGGSTYIADPARSTYYADFVKG | 1489 |
| 118N121_A2_2_OK/1-124 | 390 | KVQLVESGGGLVQAGGSLRLSCAASGRTFS | 665 | NYSVG | 940 | WFRQAPGKEREFVA | 1215 | ALSKDGARTYYAASVKG | 1490 |
| 118N121_A8_2_OK/1-124 | 391 | EVQLVESGGGLVQAGGSLTLSCVISGLTLE | 666 | SHAMG | 941 | WFRQAPGEEREFVA | 1216 | TIRWSGSATFYSDSVKG | 1491 |

TABLE A-1 -continued

Preferred combinations of CDR sequences, preferred combinations of framework sequences, and preferred combinations of framework and CDR sequences.
("ID" refers to the SEQ ID NO in the attached sequence listing)

| Clone | | | | | | | | | |
|---|---|---|---|---|---|---|---|---|---|
| 118N121_B3_1_OK/ 1-123 | 392 | EVQLVESGGGLV QPGGSLRLSCAA SGRTFS | 667 | DLALG | 942 | WFRRAPGK EREHVA | 1217 | AISSSGVTTIYA DSVRG | 1492 |
| 118N121_A5_2_OK/ 1-114 | 393 | EVQLVESGGGSV QPGGSLRLSCVA SGSISS | 668 | TNAMG | 943 | WHRQVSGK ERELVA | 1218 | IVTDGFTNYAD FAKG | 1493 |
| 118N121_A9_2_OK/ 1-114 | 394 | EVQLVESGGGSV QPGGSLRLSCVA SGSISS | 669 | VNAMG | 944 | WHRQVPGK QRELVA | 1219 | IVTDGFTNYAD FAKG | 1494 |
| 118N121_A7_1_OK/ 1-122 | 395 | EVQLVESGGGLV QPGGSLRLSCAA SGNIKS | 670 | IDVMG | 945 | WHRQAPGK ERELVS | 1220 | DISFGGNTNYA NSVKG | 1495 |
| 118N121_A10_1_OK/ 1-131 | 396 | EVQLVESGGGLV QAGGSLRLSCAA SGFSFA | 671 | DYAIG | 946 | WFRQAPGK EREGVS | 1221 | CIANSEGTKYY ADSAQG | 1496 |
| 118N121_A11_1_OK/ 1-120 | 397 | EVQLVESGGGLV QPGGSLRLSCAA SGFPFG | 672 | MYGMR | 947 | WVRQAPGK GPERVS | 1222 | SINSDGDTTYY ADSVKG | 1497 |
| 118N121_B7_4_OK/ 1-124 | 398 | EVQLVESGGGLE QAGGSLRLSCAA SGLTFR | 673 | SAAMG | 948 | WFRQAPGK EREFVA | 1223 | AISRDGAATYY TDSVKG | 1498 |
| 118N121_B2_1_OK/ 1-130 | 399 | EVQLVESGGGLV QAGGSLRLSCAA SGFSLD | 674 | DRAIA | 949 | WFRQAPGK AREGVS | 1224 | CITPHHGGIIFT RESVKG | 1499 |
| 118N121_B7_1_OK/ 1-119 | 400 | EMQLVESGGGLV QPGGSLRLSCAA SGNIPP | 675 | INAMA | 950 | WYRQAPGN ERELVA | 1225 | AVTSGGGTNY ATSVKG | 1500 |

| Clone | FR3 | ID | CDR 3 | ID | FR4 |
|---|---|---|---|---|---|
| 13D11 | RFTISRDNAKNTLFLQMNS LNPEDTAVYYCGQ | 1501 | GWKIVPTNP | 1776 | RGHGTQVTVSS |
| 2B4 | RFTISRDNAKNTLFLQMNS LSPEDTAVYYCNQ | 1502 | GWKIRPTIP | 1777 | MGHGTQVTVSS |
| 2G2 | RFTISRDNAKNTLFLQMNN LTPEDTAVYYCNR | 1503 | GWKIVPTDL | 1778 | GGHGTQVTVSS |
| 13D2 | RFTISRDNAKNTLFLQMNN LRSEDTAVYSCNQ | 1504 | GWKIVPTDR | 1779 | GGHGTQVTVSS |
| 2D5 | RFTISRDNAKNTLFLQMNS LRSEDTAVYYCNQ | 1505 | GWKIVPTDR | 1780 | GGHGTQVTVSS |
| 2F4 | RFTISRDNAKNTLFLQMNS LRSEDTAVYYCNQ | 1506 | GWKIVPTDR | 1781 | RGHGTQVTVSS |
| 2C3 | RFTISRDNAKNTLFLQMNS LRSEDTAVYYCNQ | 1507 | GWKIVPTDR | 1782 | TGHGTQVTVSS |
| 17E3 | RFTISRDNAKNTVYLEMNS LTPEDTAVYYCNQ | 1508 | GWKIVPTDR | 1783 | TGHGTQVTVSS |
| 17H3 | RFTISRDNAKNTLFLQMNS LRSEDTAVYYCNQ | 1509 | GWKIVPTDR | 1784 | GGHGTQVTVSS |
| 17D2 | RFTISRDNAKNTLFLQMNS LRSEDTAVYYCNQ | 1510 | GWKIVPTDR | 1785 | GSHGTQVTVSS |
| 2F1 | RFTISRDNAKNTLFLQMNS LTPEDTAVYYCNQ | 1511 | GWKIVPMDR | 1786 | RGHGTQVTVSS |
| 2E2 | RFTISRDNAKNTLFLQMNS LTPEDTAVYYCNQ | 1512 | GWKIIPTDR | 1787 | RGHGTQVTVSS |

TABLE A-1 -continued

Preferred combinations of CDR sequences, preferred combinations of framework sequences, and preferred combinations of framework and CDR sequences.
("ID" refers to the SEQ ID NO in the attached sequence listing)

| | | | | | |
|---|---|---|---|---|---|
| 2C2 | RFTISRDNARNTLFLQMNSLTPEDTAIYYCNQ | 1513 | GWKILPTDR | 1788 | RGHGTQVTVSS |
| 2E3 | RFTISRDNAKNTLFLQMNSLSPEDTAVYYCNQ | 1514 | GWKILPTNR | 1789 | GSHGTQVTVSS |
| 13B10 | RFTISRDNAKNTLFLQMNSLSPEDTAVYYCNQ | 1515 | GWKILPTNR | 1790 | GSHGTQVTVSS |
| 2D1 | RFTISRDNAKNTLFLQMNSLSPEDTAVYYCNR | 1516 | GWKILPTNR | 1791 | GSHGTQVTVSS |
| 2H3 | RFTISRDNAKNTLFLQMNSLTPEDTAVYYCNQ | 1517 | GWKIIPTDR | 1792 | RGHGTQVTVSS |
| 2H1 | RFVISRDNAKNTLFLQMNSLSPEDTAVYYCNQ | 1518 | GWKIIPTDR | 1793 | RGHGTQVTVSS |
| 2C1 | RFTISRDNAKNTLFLQMNSLTPEDTAVYYCNQ | 1519 | GWKIIPTDR | 1794 | RGHGTQVTVSS |
| 15C5 | RFTISRDNAKNTLFLQMNSLTPEDTAVYYCNQ | 1520 | GWKIIPTDR | 1795 | RGHGTQVTVSS |
| 2B3 | RFTISRDNAKNTLFLQMNSLTPEDTAVYYCNQ | 1521 | GWKIIPTDR | 1796 | RGHGTQVTVSS |
| 29H2 | RFTISRDNAKNTLFLQMNNLTPEDTAVYYCNQ | 1522 | GWKIIPTDR | 1797 | RGHGTQVTVSS |
| 17E4 | RFVISRDNAKNTLFLQMNSLSPEDTAVYYCNQ | 1523 | GWKIIPTDR | 1798 | RGHGTQVTVSS |
| 17A2 | RFTISRDNAKNTLFLQMNSLSPEDTAVYYCNK | 1524 | GWKVWPTDR | 1799 | GTHGTQVTVSS |
| 15D1 | RFTISRDNAKNTLFLQMNSLNPEDTAVYYCNQ | 1525 | GWKVWPTDR | 1800 | GTHGTQVTVSS |
| 17B8 | RFTISRDNAKNTLFLQMNSLTPEDTAVYYCNQ | 1526 | GWKILPAER | 1801 | RGHGTQVTVSS |
| 15C11 | RFTISRDNAKNTLFLQMNSLTPEDTAVYYCNQ | 1527 | GWKILPAER | 1802 | RGHGTPVTVSS |
| 15G8 | RFTISRDNAKNTLFLQMNSLTPENTAVYYCNQ | 1528 | GWKILPAER | 1803 | RGHGTQVTVSS |
| 17H4 | RFTISRDNAKNTLFLHMNNLSPEDTAVYYCGQ | 1529 | GWKIHPADR | 1804 | GGHGTQVTVSS |
| 27G8 | RFTISRDNAKNTLFLQMNSLTPEDTAVYYCNQ | 1530 | GWKILPAER | 1805 | RGHGTQVTVSS |
| 38C6 | RFTISRDNAKNTLFLQMNSLSPEDTAVYYCNQ | 1531 | GWKIRPTIP | 1806 | MGHGTQVTVSS |
| 2A4 | RFTISRDNAKKTVYLQMNSLQSEDTAVYYCGT | 1532 | GWQSTTKNQGY | 1807 | WGQGTQVTVSS |
| 15G7 | RFTISRDNNKKTVYLQMNSLKSEDTAVYYCAT | 1533 | GWQSTTKNQGY | 1808 | WGQGTQVTVSS |
| 15B7 | RFTISRDNAKKTVYLQMNSLQSEDTAVYYCGT | 1534 | GWQSTTKSQGY | 1809 | WGQGTQVTVSS |
| 5G4 | RFTISRDNAKKTLYLQMNSLKSEDTAVYYCAT | 1535 | GWQSTTKNQNY | 1810 | WGQGTQVTVSS |
| 13B2 | RFTISRNNANNTLYLQMNNLKFEDTAVYYCAK | 1536 | NWRDAGTTWFEKSGS | 1811 | AGQGTQVTVSS |
| 2E5 | RFTISRNNANNTLYLQMNNLKFEDTAVYYCAK | 1537 | NWRDAGTTWFEKSGS | 1812 | AGQGTQVTVSS |

TABLE A-1 -continued

Preferred combinations of CDR sequences, preferred combinations of framework sequences, and preferred combinations of framework and CDR sequences.
("ID" refers to the SEQ ID NO in the attached sequence listing)

| | | | |
|---|---|---|---|
| 15G1 | RFTISRNNANNTLYLQMNS LKSEDTAVYYCAK | 1538 NWRDAGTT WFEKSGS | 1813 AGQGTQVTVSS |
| 27B1 | RFTISRNNANNTLYLQMN NLKFEDTAVYYCAK | 1539 NWRDAGTT WFEKSGS | 1814 AGQGTQVTVSS |
| 17E7 | RFTISRNNANNTLYLQMNS LKSEDTAVYYCAK | 1540 NWRDAGTT WFEKSGS | 1815 AGQGTQVTVSS |
| 17D8 | RFTISRNNANNMLYLQMN SLKSEDTAVYYCAK | 1541 NWRDAGTT WFEKSGS | 1816 AGQGTQVTVSS |
| 5F8 | RFTISRNNANNTLYLQMN NLKFEDTAVYYCAK | 1542 NWRDAGTT WFEKSGS | 1817 AGQGTQVTVSS |
| 2D4 | RFTISRNNANNTLYLQMNS LKSDDTAVYYCAK | 1543 NWRDAGTT WFEKSGS | 1818 AGPGTQVTVSS |
| 13D8 | RFTISRNNANNTLYLQMNS LKSEDTAVYYCAK | 1544 NWGDAGTT WFEKSGS | 1819 AGQGTQVTVSS |
| 17G8 | RFTISRNNANNTLYLQMNS LKSEDTAVYYCAK | 1545 NWGDAGTT WFEKSGS | 1820 AGQGTQVTVSS |
| 2H4 | RFTISRNNANNTLYLQMNS LKSEDTAVYYCAK | 1546 NWGDAGTT WFEKSGS | 1821 AGQGTQVTVSS |
| 2F3 | RFTISRNNANNTLYLQMNS LKSDDTAVYYCAK | 1547 NWGDAGTT WFEKSGS | 1822 AGPGTQVTVSS |
| 2F5 | RFTISRNNANNTLYLQMNS LKSEDTAVYYCAK | 1548 NWGDAGTT WFEKSGS | 1823 AGQGTQVTVSS |
| 30E10 | RFTISRNNANNTLYLQMNS LKSEDTAVYYCAK | 1549 NWGDAGTT WFEKSGS | 1824 AGQGTQVTVSS |
| 29H1 | RFTISRNNANNTLYLQMNS LKSEDTAVYYCAK | 1550 NWGDAGTT WFEKSGS | 1825 AGQGTQVTVSS |
| 17E2 | RFTISRNNANNTLYLQMNS LKSEDTAVYYCAK | 1551 NWGDAGTT WFEKSGS | 1826 AGQGTQVTVSS |
| 2B1 | RFTISRNNANNTLYLQMNS LKSDDTAVYYCAK | 1552 NWGDAGTT WFEKSGS | 1827 AGPGTQVTVSS |
| 2A5 | RFTISRNNANNTLYLQMNS LKSEDTAVYYCAK | 1553 NWGDAGTT WFEKSGS | 1828 AGQGTQVTVSS |
| 13C12 | RFTISRNNANNTLYLQMNS LKSEDTAVYYCAK | 1554 NWGDAGTT WFEKSGS | 1829 AGQGTQVTVSS |
| 17E10 | RFTISRNNANNTLYLQMNS LKSEDTAVYYCAK | 1555 NWGDAGTT WFEKSGS | 1830 AGQGTQVTVSS |
| 27D4 | RFTISRNNANNTLYLQMNS LKSEDTAVYYCAK | 1556 NWGDAGTT WFEKSGS | 1831 AGQGTQVTVSS |
| 15F9 | RFTISRNNANNTLYLQMNS LKSDDTAVYYCAK | 1557 NWGDAGTT WFEKSGS | 1832 AGQGTQVTVSS |
| 30H9 | RFTISRNNANNTLYLQMNS LKSEDTAVYYCAK | 1558 NWGDAGTT WFEKSGS | 1833 AGQGTQVTVSS |
| 39C1 | RFTISRNNANNTLYLQMNS LKSEDTAVYYCAK | 1559 NWGDAGTT WFEKSGS | 1834 AGQGTQVTVSS |
| 27G2 | RFTISRNNANNTLYLQMNS LKSDDTAVYYCAK | 1560 NWGDAGTT WFEKSGS | 1835 AGPGTQVTVSS |
| 2D3 | RFTISRNNANNTLYLQMNS LKSEDTAVYYCAK | 1561 NWRDAGTT WFEKSGS | 1836 AGQGTQVTVSS |
| 5F7 | RFTISRDNAKNTVYLQMN SLKPEDTAVYYCKR | 1562 FRTAAQGTDY | 1837 WGQGTQVTVSS |

TABLE A-1 -continued

Preferred combinations of CDR sequences, preferred combinations of framework sequences, and preferred combinations of framework and CDR sequences.
("ID" refers to the SEQ ID NO in the attached sequence listing)

| Clone | Framework | ID | CDR | ID | FR4 |
|---|---|---|---|---|---|
| 118N121_A1_4_OK/1-127 | RFTISRDNAKNTLHLQMNSLKPEDTAVYYCAY | 1563 | HKTPYTTLELNRPHAFGS | 1838 | WGQGTQVTVSS |
| 47D5 | RFTISRVNAKDTVYLQMNSLKPEDTAVYYCYM | 1564 | DQRLDGSTLAY | 1839 | WGQGTQVTVSS |
| 14B11 | RFTISRDNAKKTVYLQMNSLKPEDTARYYCGV | 1565 | ETYGSGSSLMTEYDY | 1840 | WGQGTQVTVSS |
| 14B10 | RFTISRDNAKETVYLQMNSLKPDDTGVYYCAA | 1566 | ETYGSGSSLMSEYDY | 1841 | WGQGTQVTVSS |
| 14B4 | RFTISRDNAKETVYLQMNSLKPEDTGVYYCAA | 1567 | ETYGSGSSLMSEYDY | 1842 | WGQGTQVTVSS |
| 14C11 | RFTISRDNAKETVYLQMNSLKPDDTGVYYCAA | 1568 | ETYGSGSSLMSEYDY | 1843 | WGQGTQVTVSS |
| 14B5 | RFTISRDNAKETVYLQMNSLKPDDTGVYYCAA | 1569 | ETFGSGSSLMSEYDY | 1844 | WGQGTQVTVSS |
| 14C6 | RFTISRDNAKKTVYLQMNSLKPEDTAVYYCAT | 1570 | DTYGSGSSLMNEYDY | 1845 | WGQGTQVTVSS |
| 14A4 | RFTISRDNAKKTAYLQMNSLKPEDTAVYYCAA | 1571 | ETYGSGSSLMNEYDY | 1846 | WGQGTQVTVSS |
| 14B3 | RFTISRDNAKKTAYLQMNSLKPEDTAVYYCAA | 1572 | ETYGSGSSLMNEYDY | 1847 | WGQGTQVTVSS |
| 14C1 | RFTISRDNAKKTVYLQMNSLKPEDTAVYYCAT | 1573 | ETYGSGSSLMNEYDY | 1848 | WGQGTQVTVSS |
| 14A12 | RFTISRDNAKKTVYLQMNSLKPEDTAVYYCAA | 1574 | EPYGSGSSLISEYDY | 1849 | WGHGTQVTVSS |
| 14A2 | RFTISRDNAKKTVYLQMNSLKPEDTAVYYCAA | 1575 | EPYGSGSSLISEYDY | 1850 | WGHGTQVTVSS |
| 14A1 | RFTISRDNAKKTVYLQMNSLKPEDTAVYYCAA | 1576 | EPYGSGSSLMSEYDY | 1851 | WGHGTQVTVSS |
| 17C3 | RFTMARDNANHTVHLQMNSLKPEDTAVYYCNA | 1577 | NWKMLLGVENDY | 1852 | WGQGTQVTVSS |
| 46D3 | RFTVSRDIAENTVYLQMNTLKSEDTAVYYCAA | 1578 | KIGWLSIRGDEYEY | 1853 | WGQGTQVTVSS |
| 27H5 | RFTISSDNAKNTVYLQMNSLKPEDTAVYYCAA | 1579 | LPFVCPSGSYSDYGDEYDY | 1854 | WGQGTQVTVSS |
| 17C2 | RFTISRDNAKNTLYLQMSSLKPEDTALYYCTK | 1580 | HVSDSDYTEYDY | 1855 | WGQGTQVTVSS |
| 17D11 | RFTISRDNAKNTLYLQMNSLKPEDTAVYYCAA | 1581 | RRSSLYTSSNVFEYDY | 1856 | WGQGTQVTVSS |
| 15A6 | RFTVSRDNANNTVYLQMNTLKPEDTAVYYCRD | 1582 | VNADY | 1857 | WGQGTQVTVSS |
| 17B6 | RFTVSRDNAKNTVYLQMNSLKAEDTAVYYCWD | 1583 | VNADY | 1858 | WGQGTQVTVSS |
| 17C5 | RFTVSRDNANNTVYLQMNTLKPEDTAVYYCRD | 1584 | VNADY | 1859 | WGQGTPVTVSS |
| 15E11 | RFTVSRDNDKNTLYLQMNSLKPEDTAVYYCRD | 1585 | VNADY | 1860 | WGQGTQVTVSS |
| 15C2 | RFTVSRDNANNTVYLQMNTLKPEDTAVYYCRD | 1586 | VNADY | 1861 | WGQGTQVTVSS |
| 2A3 | RFTVSRDNAKNTLYLQMNSLKPEDTATYLCRD | 1587 | VNGDI | 1862 | WGQGTQVTVSS |

TABLE A-1 -continued

Preferred combinations of CDR sequences, preferred combinations of framework sequences, and preferred combinations of framework and CDR sequences.
("ID" refers to the SEQ ID NO in the attached sequence listing)

| | | | |
|---|---|---|---|
| 27A5 | RFTVSRDNAKNTLYLQMN SLEPEDTATYYCWD | 1588 VNGDI | 1863 WGQGTPVTVSS |
| 2C5 | RFTVSRDNAKNTLYLRMN SLKSEDSATYTCRA | 1589 VNADI | 1864 WGQGTQVTVSS |
| 27G5 | RFTVSRDNAKNTVYLQMN SLKPEDTAVYYCRD | 1590 VNGDY | 1865 WGQGTQVTVSS |
| 13A9 | RFTVSRDNANHTVYLQMN SLKPEDTAVYYCRD | 1591 VNGDY | 1866 WGQGTQVTVSS |
| 29E9 | RFTVSRDNAKNTVYLQMN SLKPEDTAVYYCRD | 1592 VNGDY | 1867 WGQGTQVTVSS |
| 15D8 | RFTVSRDNAKNTVYLQMN SLKPEDTAVYYCRD | 1593 VNGDY | 1868 WGQGTQVTVSS |
| 15G4 | RFTVSRDNAKNTLYLQMN SLKPEDTAVYYCWD | 1594 VNGDY | 1869 WGQGTQVTVSS |
| 15D12 | RFAISRDNAKNTAYLQMN SLKAEDTAVYYCNA | 1595 VWKLPRFV DNDY | 1870 WGQGTQVTVSS |
| 15E12 | RFTMARDNANHTVHLQM NSLKPEDTAVYYCNA | 1596 NWKMLLGV ENDY | 1871 WGQGTQVTVSS |
| 13D7 | RFTMARDNANHTVHLQM NSLKPEDTAVYYCNA | 1597 NWKMLLGV ENDY | 1872 WGQGTQVTVSS |
| 13A8 | RFTISRDNAENTVYLQMN SLKPEDTAVYYCWD | 1598 VNRDY | 1873 WGQGTQVTVSS |
| 15A4 | RFTISRDNAKNTVYLQINS LKPEDTAVYYCWD | 1599 VNRDY | 1874 WGQGTQVTVSS |
| 17F7 | RFTISRDNAKKTMYLQMN SLKPDDTAVYYCRD | 1600 VNRDY | 1875 WGQGTQVTVSS |
| 15C8 | RFTVSRDNAENTVYLQMN SLKPEDTAVYYCRD | 1601 VNRDY | 1876 WGQGTQVTVSS |
| 17A10 | RFTLSRDNAKNTVYLQMN SLKPEDTAVYYCRD | 1602 VNRDY | 1877 WGQGTQVTVSS |
| 27D3 | RFTISRDNAENTVYLQMN SLKPEDTAVYYCWD | 1603 VNRDY | 1878 WGQGTQVTVSS |
| 13B12 | RFTLSRHNAENTVYLQMN SLKPEDTAVYYCRD | 1604 VNRDY | 1879 WGQGTQVTVSS |
| 15B2 | RFTISSDNAKSTIYLQMNS LKPDDTAVYYCRD | 1605 VNRDY | 1880 WGQGTQVTVSS |
| 15B11 | RFTISSDNAKNTIYLQMNS LKPDDTAVYYCRD | 1606 VNRDY | 1881 WGQGTQVTVSS |
| 13C9 | RFTISRDNAKKTVYLQMNS LKPEDTAVYYCRD | 1607 VNRDY | 1882 WGQGTQVTVSS |
| 17D5 | RFTISRDGATNTVFLQMN NLKPEDTAVYYCRD | 1608 VNRDY | 1883 WGQGTQVTVSS |
| 27B5 | RFTVSRDNAENTVYLQMN SLKPEDTAVYYCRD | 1609 VNRDY | 1884 WGQGTQVTVSS |
| 27C7 | RFTVSRDNADNTVYLQMN SLKPEDTAVYYCRD | 1610 VNRDY | 1885 WGQGTQVTVSS |
| 13D4 | RFTISSDNAKSTIYLQMNS LEPDDTAVYYCRD | 1611 VNREY | 1886 WGQGTQVTVSS |
| 15G5 | RFTISSDNAKKTIYLQMNS LKPDDTAVYYCRD | 1612 VNREY | 1887 WGQGTQVTVSS |

TABLE A-1 -continued

Preferred combinations of CDR sequences, preferred combinations of framework sequences, and preferred combinations of framework and CDR sequences.
("ID" refers to the SEQ ID NO in the attached sequence listing)

| | | | | | |
|---|---|---|---|---|---|
| 13C4 | RFTISSDNAKSTIYLQMNSLKPDDTAVYYCRD | 1613 | VNREY | 1888 | WGQGTQVTVSS |
| 46G1 | RFTISRDNAKNAVILQMNNLKTEDTAVYYCAA | 1614 | KPGWVARDPSQYNY | 1889 | WGQGTQVTVSS |
| 46E4 | RFTISRDNAKNAVILQMNNLKTEDTAVYYCAA | 1615 | KPGWVARDPSEYNY | 1890 | WGQGTQVTVSS |
| 17B5 | RFTISNDNAKDTVYLQMNSLKSEDTAVYYCRN | 1616 | FNRDL | 1891 | WGQGTQVTVSS |
| 15C9 | RFTISRDNAKNTVYLQMNSLKPEDTGVYYCRD | 1617 | VNRDL | 1892 | WGQGTQVTVSS |
| 13D10 | RFTISKDYTRNTVYLQVNSLKPEDTAVYHCAT | 1618 | DANPNCGLNVWNS | 1893 | WGQGTQVTVSS |
| 17C6 | RFTISGDTAKSTLYLQMNSLKPEDTAMYYCYG | 1619 | RDYYYMPF | 1894 | WGQGTQVTVSS |
| 15A2 | RFAISRDNAKNTVYLQMNSLKPEDTAVYYCRD | 1620 | INEDQ | 1895 | WGQGTQVTVSS |
| 17A8 | RFAISRDNAKNMVYLQMNTLKPEDTAVYYCRD | 1621 | INEDQ | 1896 | WGQGTQVTVSS |
| 15G10 | RFAISRDNAKNTVYLQMNSLKPEDTAVYYCRD | 1622 | INEDQ | 1897 | WGQGTQVTVSS |
| 27A3 | RFAISRDNAKNTVYLQMNTLKPEDTAVYYCRD | 1623 | INEDQ | 1898 | WGQGTQVTVSS |
| 17H10 | RFAISRDNAKNTVYLQMRSLKPEDTAVYYCRD | 1624 | INADQ | 1899 | WGQGTQVTVSS |
| 30D10 | RFTISRDNAKNTVYLQMNSLKPEDTAVYYCRD | 1625 | INRDI | 1900 | WGQGSQVTVSS |
| 15H4 | RFTISRDNAKNTVYLQMNNLKPEDTAVYYCRD | 1626 | INHDI | 1901 | WGRGSQVTVSS |
| 17B7 | RFTISRDNAKKTVYLQMNSLKPEDTAVYFCRD | 1627 | INRDY | 1902 | WGQGTQVTVSS |
| 15D2 | RFTFSKDGAKNTVYLQMNSLKPEDTAVYYCRD | 1628 | INRDY | 1903 | WGQGTQVTVSS |
| 17G5 | RFTISRDNAKNTVYLQMNSLKPEDTAVYYCRD | 1629 | INRDY | 1904 | WGQGTQVTVSS |
| 15B6 | RFTLSRDNAKKTVYLQMNSLKPEDTAIYYCRD | 1630 | INGDY | 1905 | WGQGTQVTVSS |
| 27F2 | RFTISISRDNVEYTVDLQMDSLKPEDTAVYYCRD | 1631 | INGDY | 1906 | WGQGTQVTVSS |
| 17F5 | RFTISRDNAKNTVYLQVNSLKPEDTAVYYCWD | 1632 | TNGDY | 1907 | WGQGTQVTVSS |
| 17B2 | RFTISRDNAKNTLYLQMNSLKPEDTALYYCTK | 1633 | DISTFGWGPFDY | 1908 | WGQGTQVTVSS |
| 27H4 | RFTISRDNAKNTVYLEMNSLKPEDTGVYYCNG | 1634 | RWDIVGAIW | 1909 | WGQGTQVTVSS |
| 13A4 | RFTISRDNAKNTVYLEMNSLKPEDTGVYYCNG | 1635 | RWDIVGAIW | 1910 | WGQGTQVTVSS |
| 2A1 | RFTISRDNTKNTLDLQMNSLKPEDTAVYYCHG | 1636 | RWLEIGAEY | 1911 | WGQGTQVTVSS |
| 15E10 | RFTISRDNAKNTVVLQMNGLKPEDTAVYYCKG | 1637 | SWSYPGLTY | 1912 | WGKGTLVTVSS |

TABLE A-1 -continued

Preferred combinations of CDR sequences, preferred combinations of framework sequences, and preferred combinations of framework and CDR sequences.
("ID" refers to the SEQ ID NO in the attached sequence listing)

| Clone | Framework | ID | CDR | ID | FR4 |
|---|---|---|---|---|---|
| 27E7 | RFTISRDNAKNTVYLQMNDLKPEDTAVYYCNG | 1638 | VWRAIGRTY | 1913 | WGQGTQVTVSS |
| 47E5 | RFTIARDNAKNTVSLQMNSLKPEDTAVYYCNL | 1639 | DRRSYNGRQY | 1914 | WGQGTQVTVSS |
| 2G4 | RFTISRDNTKNTMYLQMVSLKPEDTAVYYCNV | 1640 | GGREYSGVYYYREY | 1915 | WGQGTQVTVSS |
| 14D4 | RFTISRDNAKNTVYLQMASLKPEDTAAYYCAA | 1641 | RPSDTTWSESSAS | 1916 | WGQGTQVTVSS |
| 17A5 | RFTISRDNVKNTLYLQMNSLKSEDTAVYYCAK | 1642 | DLGNSGRGPYTN | 1917 | WGQGTQVTVSS |
| 15D10 | RFTISRDNAKNTVYLQMNSLKPEDTAVYYCAT | 1643 | DCGVPGFGWTFSS | 1918 | WGQGTQVTVSS |
| 13C2 | RFTISRDNAKNAVHLQMNSLRLEDTAVYYCNA | 1644 | KQLPYLQNF | 1919 | WGQGTQVTVSS |
| 17G11 | RFTISRDNPETAVHLQMNSLKLEDTAVYYCNA | 1645 | KQLPYLQNF | 1920 | WGQGTQVTVSS |
| 17A3 | RFTISRDNARDTLFLQMHALQPEDTAVYMCNL | 1646 | HRWGLNY | 1921 | WGQGTQVTVSS |
| 27B7 | RFTISRDNAKNTLYLQMSSLKPEDTALYYCAK | 1647 | ARSSSSYYDFGS | 1922 | WGQGTQVTVSS |
| 17A6 | RFTISTDNAKNTLYLQMSSLKPEDTALYYCAK | 1648 | ARSSSSYYDFGS | 1923 | WGQGTQVTVSS |
| 17D7 | RFTISRDNAKNTVYLQMNSLKPEDTAVYYCAT | 1649 | DRGSGTCYADFGS | 1924 | WGQGTQVTVSS |
| 46D4 | RFTISRDNAKKTLYLQMNSLQSEDTAVYYCAK | 1650 | GWGPAVTSIPV | 1925 | ATLGTQVTVSS |
| 27B3 | RFTISRDNAKNTVYLQMNSLKPEDTAVYYCRD | 1651 | INRDI | 1926 | WGQGSQVTVSS |
| 27E5 | RFTISRDNAKNTVYLQMNSLKPEDTAVYYCRD | 1652 | INRDI | 1927 | WGQGSQVTVSS |
| 27D6 | RFTISRDNAKNTVYLQMNSLKPEDTAVYYCRD | 1653 | INRDI | 1928 | WGQGSQVTVSS |
| 30D10 | RFTISRDNAKNTVYLQMNSLKPEDTAVYYCRD | 1654 | INRDI | 1929 | WGQGSQVTVSS |
| 47G11 | RFTISRDNAKNTVYLQMNSLKPEDTAVYYCAS | 1655 | SRDYSRSRDPTSYDR | 1930 | WGQGTQVTVSS |
| 27C3 | RFTISRDNAKNTLYLQMNSLKPEDTAVYYCAR | 1656 | PRGSSLYLLEYDY | 1931 | WGQGTQVTVSS |
| 11A101/1-120 | RFTTSRDNAKNTVYLQMNDLKPEDTAVYYCAA | 1657 | DFYLATLAHEYDY | 1932 | WGQGTQVTVSS |
| 11A22/1-122 | RFTISRDNAKNTVYLQMNSLKPEDTAVYYCAA | 1658 | DFYVSTLAHEYDY | 1933 | WGQGTQVTVSS |
| 12D44/1-122 | RFTISRANAKNTVYLQMNGLKPEDTAVYYCAA | 1659 | DFYVSTLAHEYDY | 1934 | WGQGTQVTVSS |
| 12E11/1-122 | RFTISRDNAKITVYLQMNSLKPEDTAVYYCAA | 1660 | DFYVSTLAHEYDY | 1935 | WGQGTQVTVSS |
| 13G111/1-123 | RFTISRDNAKNTVYLQMNSLKPEDTAVYYCAA | 1661 | DTFTLSTLSHEYDY | 1936 | WGQGTQVTVSS |
| 13F71/1-123 | RFTISRDNAKNTVYLQMNSLKPEDTAVYYCAA | 1662 | DLIVATLPGEYDY | 1937 | WGQGTQVTVSS |

TABLE A-1 -continued

Preferred combinations of CDR sequences, preferred combinations of framework sequences, and preferred combinations of framework and CDR sequences.
("ID" refers to the SEQ ID NO in the attached sequence listing)

| | | | | | |
|---|---|---|---|---|---|
| 14H61/1-122 | RFTISRDNAKNTVYLQMNSLSPEDTAVYYCAA | 1663 | DEILATLPHEYDY | 1938 | WGQGTQVTVSS |
| 22B12/1-124 | RFTISRDNAKNTVYLQMNSLKPEDTAVYYCAA | 1664 | DAYTVIATLPHEYDY | 1939 | WGQGTQVTVSS |
| 14H71/1-123 | RFTISRDSAKNAVNLQMELVESDDTAVYYCAA | 1665 | KHSTVAGLTHEYDY | 1940 | WGQGTQVIVSS |
| 12D51/1-120 | RFTISRDSAKNTVYLQMDSLKPEDTAVYVCNA | 1666 | VYVSTWGNGYDY | 1941 | WGQGTQVTVSS |
| 11A111/1-126 | RFTISRDNAKNSVYLQMNSLKPEDTAIYYCAA | 1667 | RRSGYYSLSTSPHQYAY | 1942 | WGQGTQVTVSS |
| 13G71/1-124 | RFTISRDNAKNTVYLQMNSLKPEDTAVYYCGA | 1668 | RVNYAAYSRLEHDYHY | 1943 | WGQGTQVTVSS |
| 13G74/1-125 | RFTISRDNAKNTVYLQMNSLKPEDTAVYYCGA | 1669 | RVNYAAYSRLEHDYHY | 1944 | WGQGTQVTVSS |
| 11A71A/1-116 | RFTIARDDAKNTMYLQMNGMKPEDTAVYYCKM | 1670 | NRAGIYEY | 1945 | WGQGTQVTVSS |
| 22B101/1-123 | RFDISRDNAKNTVYLQMNRLKPEDTAVYYCAA | 1671 | RLFMATPNQGQYYY | 1946 | WGQGTQVTVSS |
| 11B42/1-123 | RFAISRDNALNTVYLQMNSLKPEDTAVYYCAA | 1672 | RPSYSTNNVKSYRY | 1947 | WGQGTQVTVSS |
| 13E111/1-124 | RFTISRDNGKNTVDLRMNSLKPEDTAVYYCAA | 1673 | RPAVVHTRKESYPY | 1948 | WGQGTQVTVSS |
| 14H12/1-125 | RFTISRDNAKNTVYLQMNSLKPEDTAVYYCAA | 1674 | RINYSVLTTTSSSYHY | 1949 | WGQGTQVTVSS |
| 13G101/1-123 | RFTISRDDAKNTVYLQMNSLKAEDTAIYYCAA | 1675 | DFRSTWLSSSGSSYTY | 1950 | WGQGTQVTVSS |
| 13G41/1-121 | RFTVSRDNAQNTVYLQMNSLKIEDTGVYYCNA | 1676 | RRIVNVEGAYRDY | 1951 | WGQGTQVTVSS |
| 22B910/1-121 | RFTISGDDARNTVYLQMNSLNPEDTAVYYCNA | 1677 | KVVVAVEGAKYDY | 1952 | WGQGTQVTVSS |
| 21A81/1-122 | RFTISRDNSENTVYFEMGSLKPEDTAVYYCAI | 1678 | CRISWCAGAESDYGY | 1953 | WGQGTQVTVSS |
| 21A92/1-127 | RFTISRDNAKGTVYLQMSSLKPEDTAVYYCAA | 1679 | DSITDRRSVAVAHTSYYY | 1954 | WGQGTQVTVSS |
| 22C712/1-123 | RFTISRDNTKNTVYLQMNSMRPEDTAVYYCAA | 1680 | RLSSVAVASTRYDY | 1955 | WGQGTQVTVSS |
| 11A13/1-125 | RFTISRDIANDVVYLQMNSLEPEDTAVYYCAR | 1681 | NRQSGVASENLRLYTY | 1956 | WGQGTQVTVSS |
| 13G93/1-123 | RFTISRDNAKNTLYLQTTSLRPEDTGVYYCAE | 1682 | DKQSGVSVNPKYAY | 1957 | WGQGTQVTVSS |
| 12C52/1-118 | RFTISKDNAKNTVYLQMNSLKPEDTAVYYCAA | 1683 | QTLGRSLYDY | 1958 | WGQGTQVTVSS |
| 12C61/1-126 | RFTISRDNAKNTVYLQMNSLKPEDTAVYYCAA | 1684 | SRYSGGVATARRSEYHY | 1959 | WGQGTQVTVSS |
| 21A61/1-125 | RFTISRDYAKNTWYLQMNTLKPEDTAAYYCAA | 1685 | VATYSRNVGSVRNYDY | 1960 | WGQGTQVTVSS |
| 11A121/1-126 | RFTISRDNAKNTVQLQMNSLKPEDTAVYYCAV | 1686 | SQPLNYYTYYDARRYDY | 1961 | WGQGTQVTVSS |
| 11A91/1-124 | RFTISRDNAKNTVYLQMTSLMPEDTAVYYCAD | 1687 | TPVYYQRYYDQNAYDY | 1962 | WGQGTQVTVSS |

TABLE A-1 -continued

Preferred combinations of CDR sequences, preferred combinations of framework sequences, and preferred combinations of framework and CDR sequences.
("ID" refers to the SEQ ID NO in the attached sequence listing)

| Clone/Range | Framework | ID | CDR | ID | FR4 |
|---|---|---|---|---|---|
| 13G72/1-118 | RFTISRDNAKNTVYLQMNSLKPEDTAVYYCAA | 1688 | KYYSYYAYDY | 1963 | WGQGTQVTVSS |
| 13E81/1-124 | RFTISRDNAKDTMYLQMNVLKPEDTAVYYCAA | 1689 | SPVYYIDYSSQYKYGY | 1964 | WGQGTQVTVSS |
| 11B31/1-124 | RFTISRDNAKNTVYLRMNSLKPEDTAVYYCAT | 1690 | QIYYRTNYYSQNAYDY | 1965 | WGQGTQVTVSS |
| 13G81/1-124 | RFTISRDDAKNTVYLQMNSLKPEDTAVYLCAA | 1691 | QIYYRTNYYSQNNYDY | 1966 | WGQGTQVTVSS |
| 21A53/1-124 | RVTISRDDAKNTVYLRMNSLKPEDTAVYYCAA | 1692 | QIYYRTNYYSQNVYDY | 1967 | WGQGTQVTVSS |
| 14H51/1-124 | RFTISRDDAKNTVYLRMNSLKPEDTAVYYCAA | 1693 | QIYYRTNYYSQNEYDY | 1968 | WGQGTQVTVSS |
| 21A21/1-124 | RFTISRDNAKNTVYLRMNSLKPEDTAVYYCAA | 1694 | QIYYRTNYSSQSNYDY | 1969 | WGQGTQVTVSS |
| 21A111/1-124 | RFTIARDDAKNTVYLQMNSLKPEDTAVYYCAL | 1695 | ATAYRTNYSSRDKYDY | 1970 | WGQGTQVTVSS |
| 22B1212/1-122 | RFTISRDNAKNTLYLQMNSLKPEDTAVYYCAK | 1696 | YLSFYSDYEVYDY | 1971 | WGQGTQVTVSS |
| 11A31/1-120 | RFTISRDNAKNGVSLQMDSLKAEDTAVYYCAS | 1697 | DPTYGSGRWTY | 1972 | WGQGTQVTVSS |
| 13E51/1-128 | RFTISSDNAKNTVYLQMNSLKPEDTALYYCAR | 1698 | SVTYYSGSHAYTQEGGYAR | 1973 | WGQGTQVTVSS |
| 12D121/1-126 | RFTISRDDAKNTVYLQMNSLKPEDTAVYYCAA | 1699 | RQPYASGSHYSSTQYTY | 1974 | WGQGTQVTVSS |
| 13F121/1-119 | RFTISIDNAKNTVYLQMNNLTPEDTAVYYCAA | 1700 | LYRGRSVYD | 1975 | WGQGTQVTVSS |
| 13G121/1-127 | RFTISRDNAKNTVYLQMDSLKPEDTAVYYCAA | 1701 | SSYGSTYYSQGRAYYYDY | 1976 | WGQGTQVTVSS |
| 22B41/1-124 | RFTISKENAKNTVYLQMTILKPEDTAVYYCAS | 1702 | SPYGPLYRSTHYYDY | 1977 | WGQGTQVTVSS |
| 12D71/1-125 | RFTISRDSAKDTVYLQMNNLKPEDTAVYYCAA | 1703 | TTYYSGSYISTLSTSYNY | 1978 | WGQGTQVTVSS |
| 13F42/1-111 | RFTISRDNAKNAVNLQMSNLKPEDTALHYCTI | 1704 | GSY | 1979 | RGQGTQVTVSS |
| 12C101/1-111 | RFTISRDNARNAVNPQMNNLKPEDTAVYYCTI | 1705 | GSY | 1980 | RGQGTQVTVSS |
| 14H91/1-127 | RFTISRDNAKNAVYLQMNSLKPEDTAVYYCAA | 1706 | RDSSTLDSTYYVGGSYNY | 1981 | WGRGTQVTVSS |
| 13F41/1-111 | RFTISRDNAKNAVNLQMSNLKPEDTALYYCTI | 1707 | GSY | 1982 | RGQGTQVTVSS |
| 14H21/1-125 | RFTISRSIAENTVYLQMNKVKPEDTAVYYCAA | 1708 | RMYGSDWLPRPEDFDS | 1983 | WGQGTQVTVSS |
| 22B610/1-120 | RFTISRDNAKNTVYLQMNSLKPEDTAVYYCNA | 1709 | DVSPSYGSRWYG | 1984 | WGQGTQVTVSS |
| 12C32/1-127 | RFTISRDNAKSTMYLQMNSLKPEDTAVYYCAA | 1710 | RREYSTIYTARYPGEYVY | 1985 | WGQGTQVTVSS |
| 12D61/1-116 | RFTISRDNAKNTLYLQMNSLKAEDTAVYYCNA | 1711 | RERGIYDS | 1986 | WGQGTQVTVSS |

TABLE A-1 -continued

Preferred combinations of CDR sequences, preferred combinations of framework sequences, and preferred combinations of framework and CDR sequences. ("ID" refers to the SEQ ID NO in the attached sequence listing)

| | | | | | |
|---|---|---|---|---|---|
| 13G31/1-125 | RFTISRDDAKNSIYLQMNTLKPEDTAVYYCAA | 1712 | DDYLGGDNWYLGPYDS | 1987 | WGQGTQVTVSS |
| 22C65/1-124 | RFTISRDNAKNTVYLQMNSLIPEDTAVYYCAA | 1713 | RKTYRSLTYYGEYDS | 1988 | WGQGTQVTVSS |
| 11A71/1-125 | RFTVSRDNGRNTVYLLQMNSLKPEDTAVYYCNV | 1714 | DRLLYYSSGYYQTSVDV | 1989 | WGQGTQVTVSS |
| 11B91/1-125 | RFTISRDKAKNTVLLQMDSLKPEDTAVYYCNA | 1715 | DRFLYYSAGRYDTGSDI | 1990 | WGQGTQVTVSS |
| 11A81/1-125 | RFTISRDKAKNALYLQMNSLKPEDMAVYYCNA | 1716 | DRVLYYSDSRYYTGSNY | 1991 | WGQGTQVTVSS |
| 11B121/1-127 | RFTISRDNAKNTVYLEMNNLKPEDTAVYYCNA | 1717 | DRALYRNYSDGRYYTGYDY | 1992 | WGQGTQVTVSS |
| 12D31/1-115 | RFTISRDNAENTVYLQMNNLKPEDMAVYYCNA | 1718 | RILSRNY | 1993 | WGQGNQVTVSS |
| 11B51/1-127 | RFTISRDNAKSTVYLQMDSLKPEDTAVYYCAA | 1719 | SRRFYSGLYYYTDDAYEY | 1994 | WGQGTQVTVSS |
| 13G51/1-127 | RFTISRDNSKNTVSLQMNSLKPEDTAVYYCAA | 1720 | SRRFYSGLVYYSVDAYEN | 1995 | WGQGTQVTVSS |
| 13F82A/1-130 | RFTIFRDNAENTAYLQMNSLNPEDTAVYYCAV | 1721 | TKRYYSIKYYSTVEDYEY | 1996 | WGQGTQVTVSS |
| 13E101/1-128 | RFTISRDNAESTVYLQMNSLKAEDTAVYYCAA | 1722 | NRYYCSTYGCLSTPRQYDY | 1997 | WGQGTQVTVSS |
| 22B85/1-120 | RFAISRDGAKNTVYLQMDSLKPEDTAVYYCNL | 1723 | RVYTGTYGGRNY | 1998 | WGQGTQVTVSS |
| 11B12/1-118 | RFAISRDNAKNTVYLQMHSLKPEDTAVHCAT | 1724 | GYSLPAFDS | 1999 | WGPGTQVTVSS |
| 13G61/1-118 | RFTISRDNADNTVTLQMNSLKPEDTAVYYCAG | 1725 | GIDLYTFHY | 2000 | FGQGTQVTVSS |
| 14H41/1-118 | RFTISRDNADNTVTLQMNSLKPEDTAVYYCAG | 1726 | GIDLYTFDY | 2001 | FGQGTQVTVSS |
| 11B81/1-126 | RFTISRDNAEDLLYLQMNLLKPEDTAVYYCAA | 1727 | NSDSGFDSYSVWAAYEY | 2002 | WGQGTQVTVSS |
| 11C11/1-121 | RFTISKNTAENTVYLQMNSLKPEDTAVYYCAV | 1728 | LLTVWDTYKY | 2003 | WGQGTQVTVSS |
| 12D92/1-123 | RFTISRANDNNPLYLQMNTLKPEDTAVYYCAA | 1729 | TNRWYTGVYDLPSRYEY | 2004 | WGQGTQVTVSS |
| 13E61/1-123 | RFTISRDNAINSLYLQMDTLKPEDTAVYYCAA | 1730 | TNRWFSAVYDLPSRYTY | 2005 | WGQGTQVTVSS |
| 22B71/1-114 | RFSISRDNALKTVYLQMNSLKPEDTAVYYCYA | 1731 | DLPSRL | 2006 | WGQGTQVTVSS |
| 21A121/1-123 | RFTISRDYDNSPVYLQMNTLKPEDTAVYYCAA | 1732 | TSRWYSAVYDLPTRYDY | 2007 | WGQGTQVTVSS |
| 13F101/1-124 | RFTISRDNAKNTVYLQMNSLEREDTAVYYCAA | 1733 | DRSYSIDYRHPDSYSY | 2008 | WGQGTQVTVSS |
| 11A43/1-123 | RFTISRDNAKNTVTLQMNSLRPEDTAVYYCAA | 1734 | DPLLFYGVGSADVDY | 2009 | WGQGTQVTVSS |
| 12C81/1-117 | RFTISRDNAKNSVYLQMNSLKPEDTSVYYCNV | 1735 | ISGLVQRDY | 2010 | WGQGTQVTVSS |

TABLE A-1 -continued

Preferred combinations of CDR sequences, preferred combinations of framework sequences, and preferred combinations of framework and CDR sequences.
("ID" refers to the SEQ ID NO in the attached sequence listing)

| ID | Framework | ID | CDR | ID | Framework |
|---|---|---|---|---|---|
| 11B21/1-124 | RFTISRDNARNIVYLQMNSLKPEDTAVYYCAA | 1736 | GGHLLGYDVQWEPDY | 2011 | WGQGTQVTVSS |
| 11B71/1-126 | RFTISRDNAKNIVYLQMNSLKPEDTAVYYCAA | 1737 | HKRTYELGAHSTDFGS | 2012 | WGQGTQVTVSS |
| 12C121/1-126 | RFTISRDNAKNAVYLQMNSLKPEDTGVYYCAT | 1738 | AVFVDSGDFSVCRGVGY | 2013 | WGQGTQVTVSS |
| 22C51/1-121 | RFTISRDNAKNTVYLQMNSLKPEDTAVYYCAA | 1739 | LRSWPRGVDSGS | 2014 | WGQGTQVTVSS |
| 12D11/1-123 | RFTISRDNTKNTIDLQINSLKPEDTAVYYCAA | 1740 | DVIYKNIGSGSFDY | 2015 | WGQGTQVTVSS |
| 12D14/1-123 | RFTISRDNTKNTIDLQINSLKPEDTAVYYCAA | 1741 | DVIYKNIGSGSFDY | 2016 | WGQGTQVTVSS |
| 12C111/1-123 | RFIVSRDNAKNTADLQMNDLKPEDTAVYYCGA | 1742 | SKWYGGFGDTDIEY | 2017 | WGQGTQVTVSS |
| 22B55/1-123 | RFIVSRDNAKNTADLQMNELKPEDTAVYYCGA | 1743 | SKWYGGFGDTDIEY | 2018 | WGQGTQVTVSS |
| 14H121/1-113 | RFTISRDDAKNTVFLQMNSLKPEDTAVYYCNV | 1744 | DGPFGN | 2019 | WGQGTQVTVSS |
| 12C71/1-125 | RFTISRENVKDTMYLQMNSLQAEDTGVYYCVR | 1745 | SRHSGNTLSFSLKYDY | 2020 | WGQGTQVTVSS |
| 21A31/1-125 | RFTISRDNARNTAYLQMDSLRPEDTAVYSCAA | 1746 | RRWSGTLSLFDNEYYY | 2021 | WGQGTQVTVSS |
| 12C91/1-121 | RFTISRGNAKNTVNLQMNSLKPEDTAVYYCAA | 1747 | DNYRDSYLEYDY | 2022 | WGQGTQVTVSS |
| 14H81/1-125 | RFTISRDNTESTGYLQMNNLKPEDTAVYYCAA | 1748 | SWDHGDYVDGGFFYDY | 2023 | WGQGTQVTVSS |
| 12C42/1-124 | RFTISRDNAKNMVYLQMNSLKPEDTAVYYCAA | 1749 | AGSAGPPSIDRQYDY | 2024 | WGQGTQVTVSS |
| 12D102/1-118 | RFTISRDYAKNTAYLQMNSLKPEDTAVYYCVA | 1750 | DVRDSIWRSY | 2025 | WGQGTQVTVSS |
| 11A52/1-120 | RFTISRDNAENTVYLQMNSLTPEDTAVYYCAS | 1751 | GWGATQAQSGF | 2026 | WGQGTQVTVSS |
| 14H111/1-120 | RFTISRDNAENTVYLLMNSLIPEDTAVYYCAT | 1752 | GWGATQAQHGF | 2027 | WGQGTQVTVSS |
| 11B61/1-120 | RFTIYRDNAQNTMYLQMNSLKPEDTAVYYCAA | 1753 | SSSLATISQPSS | 2028 | WGQGTQVTVSS |
| 12E42/1-118 | RFTVSRDNAKNTVYLQMNSLKPEDTAVYYCNA | 1754 | KAVTSRDHEY | 2029 | WGQGTQVTVSS |
| 13F81A/1-128 | RSTISRENAENTVYLQMNSLKPEDTAVYYCAA | 1755 | NSDEFYSGTLKLQSRMVEY | 2030 | WGQGTQVTVSS |
| 11B102/1-118 | RFTISRDNAKKTAYLLIMNSLRPEDTAVYYCVG | 1756 | GWKTDEYVK | 2031 | WGQGTQVTVSS |
| 21A41/1-120 | RFTISRDNTKNTVYLQMNSLKPEDTAVYYCRP | 1757 | GWVTPSYEYGN | 2032 | WGQGTQVTVSS |
| 14H101/1-128 | RFTISRDNAKNTVDLQMSSLKPEDTAAYYCAA | 1758 | DQKYGMSYSRLWLVSEYEY | 2033 | WGQGTQVTVSS |
| 12E21/1-115 | RFTISRDNAENLVYLQMNNLKPEDTAVYYCSA | 1759 | GWGDSAY | 2034 | WGQGTQVTVSS |
| 13F21/1-123 | RFTISRDAAANLVYLQMNSLKPSDTAIYSCNA | 1760 | NGIESYGWGNRHFNY | 2035 | WTVGTQVTVSS |

TABLE A-1 -continued

Preferred combinations of CDR sequences, preferred combinations of framework sequences, and preferred combinations of framework and CDR sequences.
("ID" refers to the SEQ ID NO in the attached sequence listing)

| | | | | | |
|---|---|---|---|---|---|
| 12E33/1-119 | RFIISRDNAKNTVYLQINSLKPEDTAVYYCAA | 1761 | GGWGTGRYNY | 2036 | WGVGTQVTVSS |
| 13G11/1-122 | RFTISRDNAKNTVYLQMNNLKSEDTAVYYCAP | 1762 | GWGTAPLSTSVY | 2037 | WGQGTQVTVSS |
| 118N121_A6_2_OK/1-123 | RFTFSRDNAKNTVYLQMNSLKPEDTAIYLCAV | 1763 | DRFNTIANLPGEYDY | 2038 | WGQGTQVTVSS |
| 118N121_B8_1_OK/1-135 | RFTISRDNAKNTVYLQMNSLKPEDTAVYYCAC | 1764 | ETFNSISNLPGEYDY | 2039 | WGQGTQVTVSS |
| 118N121_A2_2_OK/1-124 | RFTIYRDNAKNWYLQMSVLNGEDTAVYYCAA | 1765 | DHFTFMSNLPSEYDY | 2040 | WGQGTQVTVSS |
| 118N121_A8_2_OK/1-124 | RFTISRDNAKNTVYLQMNSLKPEDTAVYYCAA | 1766 | RKIYRSLSYYGDYDS | 2041 | WGQGTQVTVSS |
| 118N121_B3_1_OK/1-123 | RFTISRDEAKNTVYLEMNSLKTDDTAVYYCAA | 1767 | RLTMATPNQSQYYY | 2042 | WGQGTQVTVSS |
| 118N121_A5_2_OK/1-114 | RFTISRDNAKTIVYLQMNSLQPEDTARYYCRY | 1768 | SGIGTDN | 2043 | WGQGIEVTVSS |
| 118N121_A9_2_OK/1-114 | RFTISRDNAKTTVYLQMNSLQPEDTARYYCRY | 1769 | SGIGTDN | 2044 | WGQGIEVTVSS |
| 118N121_A7_1_OK/1-122 | RFTISRDNAKNTVYLQMNSLKPEDTAVYYCYA | 1770 | DILYKTDIYYRNDF | 2045 | WGQGTQVTVSS |
| 118N121_A10_1_OK/1-131 | RLPISSDNAKKTVYLQMDSLKPEDTAVYYCAA | 1771 | LPYTICPVVVKKGAVYYGVDDY | 2046 | WGKGTQVTVSS |
| 118N121_A11_1_OK/1-120 | RFTISRDNDENMLYLQMNSLKPEDTAVYYCAT | 1772 | GFSDRSFAVTH | 2047 | KGQGTQVTVSS |
| 118N121_B7_4_OK/1-124 | RFTISRDNAKNTVFLQMNSLKPEDTAIYYCAA | 1773 | DFRLARLRVADDYDY | 2048 | WGQGTQVTVSS |
| 118N121_B2_1_OK/1-130 | RFATSSDSAKNTVYLQMHSLKPSDTAVYYCAT | 1774 | LRTDYSINWANCQRDSLYGY | 2049 | WGQGTQVTVSS |
| 118N121_B7_1_OK/1-119 | RFIISRDDSKNTVDLQMNSLKPEDTAVYYCNL | 1775 | GGWTRTHPFDY | 2050 | WGQGTQVTVSS |

Thus, in the Nanobodies of the invention, at least one of the CDR1, CDR2 and CDR3 sequences present is suitably chosen from the group consisting of the CDR1, CDR2 and CDR3 sequences, respectively, listed in Table A-1; or from the group of CDR 1, CDR2 and CDR3 sequences, respectively, that have at least 80%, preferably at least 90%, more preferably at least 95%, even more preferably at least 99% "sequence identity" (as defined herein) with at least one of the CDR1, CDR2 and CDR3 sequences, respectively, listed in Table A-1; and/or from the group consisting of the CDR1, CDR2 and CDR3 sequences, respectively, that have 3, 2 or only 1 "amino acid difference(s)" (as defined herein) with at least one of the CDR1, CDR2 and CDR3 sequences, respectively, listed in Table A-1.

In this context, by "suitably chosen" is meant that, as applicable, a CDR1 sequence is chosen from suitable CDR1 sequences (i.e. as defined herein), a CDR2 sequence is chosen from suitable CDR2 sequences (i.e. as defined herein), and a CDR3 sequence is chosen from suitable CDR3 sequence (i.e. as defined herein), respectively. More in particular, the CDR sequences are preferably chosen such that the Nanobodies of the invention bind to HER2 with an affinity (suitably measured and/or expressed as a $K_D$-value (actual or apparent), a $K_A$-value (actual or apparent), a $k_{on}$-rate and/or a $k_{off}$-rate, or alternatively as an $IC_{50}$ value, as further described herein) that is as defined herein.

In particular, in the Nanobodies of the invention, at least the CDR3 sequence present is suitably chosen from the group consisting of the CDR3 sequences listed in Table A-1 or from the group of CDR3 sequences that have at least 80%, preferably at least 90%, more preferably at least 95%, even more preferably at least 99% sequence identity with at least one of the CDR3 sequences listed in Table A-1; and/or from the group consisting of the CDR3 sequences that have 3, 2 or only 1 amino acid difference(s) with at least one of the CDR3 sequences listed in Table A-1.

Preferably, in the Nanobodies of the invention, at least two of the CDR1, CDR2 and CDR3 sequences present are suitably chosen from the group consisting of the CDR1, CDR2 and CDR3 sequences, respectively, listed in Table A-1 or from the group consisting of CDR1, CDR2 and CDR3 sequences, respectively, that have at least 80%, preferably at least 90%, more preferably at least 95%, even more preferably at least 99% sequence identity with at least one of the CDR1, CDR2 and CDR3 sequences, respectively, listed in Table A-1; and/or from the group consisting of the CDR1, CDR2 and CDR3 sequences, respectively, that have 3, 2 or only 1 "amino acid difference(s)" with at least one of the CDR1, CDR2 and CDR3 sequences, respectively, listed in Table A-1.

In particular, in the Nanobodies of the invention, at least the CDR3 sequence present is suitably chosen from the group consisting of the CDR3 sequences listed in Table A-1 or from the group of CDR3 sequences that have at least 80%, preferably at least 90%, more preferably at least 95%, even more preferably at least 99% sequence identity with at least one of the CDR3 sequences listed in Table A-1, respectively; and at least one of the CDR1 and CDR2 sequences present is suitably chosen from the group consisting of the CDR1 and CDR2 sequences, respectively, listed in Table A-1 or from the group of CDR1 and CDR2 sequences, respectively, that have at least 80%, preferably at least 90%, more preferably at least 95%, even more preferably at least 99% sequence identity with at least one of the CDR1 and CDR2 sequences, respectively, listed in Table A-1; and/or from the group consisting of the CDR1 and CDR2 sequences, respectively, that have 3, 2 or only 1 amino acid difference(s) with at least one of the CDR1 and CDR2 sequences, respectively, listed in Table A-1.

Most preferably, in the Nanobodies of the invention, all three CDR1, CDR2 and CDR3 sequences present are suitably chosen from the group consisting of the CDR1, CDR2 and CDR3 sequences, respectively, listed in Table A-1 or from the group of CDR1, CDR2 and CDR3 sequences, respectively, that have at least 80%, preferably at least 90%, more preferably at least 95%, even more preferably at least 99% sequence identity with at least one of the CDR1, CDR2 and CDR3 sequences, respectively, listed in Table A-1; and/or from the group consisting of the CDR1, CDR2 and CDR3 sequences, respectively, that have 3, 2 or only 1 amino acid difference(s) with at least one of the CDR1, CDR2 and CDR3 sequences, respectively, listed in Table A-1.

Even more preferably, in the Nanobodies of the invention, at least one of the CDR1, CDR2 and CDR3 sequences present is suitably chosen from the group consisting of the CDR1, CDR2 and CDR3 sequences, respectively, listed in Table A-1. Preferably, in this aspect, at least one or preferably both of the other two CDR sequences present are suitably chosen from CDR sequences that have at least 80%, preferably at least 90%, more preferably at least 95%, even more preferably at least 99% sequence identity with at least one of the corresponding CDR sequences, respectively, listed in Table A-1; and/or from the group consisting of the CDR sequences that have 3, 2 or only 1 amino acid difference(s) with at least one of the corresponding sequences, respectively, listed in Table A-1.

In particular, in the Nanobodies of the invention, at least the CDR3 sequence present is suitably chosen from the group consisting of the CDR3 listed in Table A-1. Preferably, in this aspect, at least one and preferably both of the CDR1 and CDR2 sequences present are suitably chosen from the groups of CDR1 and CDR2 sequences, respectively, that have at least 80%, preferably at least 90%, more preferably at least 95%, even more preferably at least 99% sequence identity with the CDR1 and CDR2 sequences, respectively, listed in Table A-1; and/or from the group consisting of the CDR1 and CDR2 sequences, respectively, that have 3, 2 or only 1 amino acid difference(s) with at least one of the CDR1 and CDR2 sequences, respectively, listed in Table A-1.

Even more preferably, in the Nanobodies of the invention, at least two of the CDR1, CDR2 and CDR3 sequences present are suitably chosen from the group consisting of the CDR1, CDR2 and CDR3 sequences, respectively, listed in Table A-1. Preferably, in this aspect, the remaining CDR sequence present is suitably chosen from the group of CDR sequences that have at least 80%, preferably at least 90%, more preferably at least 95%, even more preferably at least 99% sequence identity with at least one of the corresponding CDR sequences listed in Table A-1; and/or from the group consisting of CDR sequences that have 3, 2 or only 1 amino acid difference(s) with at least one of the corresponding sequences listed in Table A-1.

In particular, in the Nanobodies of the invention, at least the CDR3 sequence is suitably chosen from the group consisting of the CDR3 sequences listed in Table A-1, and either the CDR1 sequence or the CDR2 sequence is suitably chosen from the group consisting of the CDR1 and CDR2 sequences, respectively, listed in Table A-1. Preferably, in this aspect, the remaining CDR sequence present is suitably chosen from the group of CDR sequences that have at least 80%, preferably at least 90%, more preferably at least 95%, even more preferably at least 99% sequence identity with at least one of the corresponding CDR sequences listed in Table A-1; and/or from the group consisting of CDR sequences that have 3, 2 or only 1 amino acid difference(s) with the corresponding CDR sequences listed in Table A-1.

Even more preferably, in the Nanobodies of the invention, all three CDR1, CDR2 and CDR3 sequences present are suitably chosen from the group consisting of the CDR1, CDR2 and CDR3 sequences, respectively, listed in Table A-1.

Also, generally, the combinations of CDR's listed in Table A-1 (i.e. those mentioned on the same line in Table A-1) are preferred. Thus, it is generally preferred that, when a CDR in a Nanobody of the invention is a CDR sequence mentioned in Table A-1 or is suitably chosen from the group of CDR sequences that have at least 80%, preferably at least 90%, more preferably at least 95%, even more preferably at least 99% sequence identity with a CDR sequence listed in Table A-1; and/or from the group consisting of CDR sequences that have 3, 2 or only 1 amino acid difference(s) with a CDR sequence listed in Table A-1, that at least one and preferably both of the other CDR's are suitably chosen from the CDR sequences that belong to the same combination in Table A-1 (i.e. mentioned on the same line in Table A-1) or are suitably chosen from the group of CDR sequences that have at least 80%, preferably at least 90%, more preferably at least 95%, even more preferably at least 99% sequence identity with the CDR sequence(s) belonging to the same combination and/or from the group consisting of CDR sequences that have 3, 2 or only 1 amino acid difference(s) with the CDR sequence(s) belonging to the same combination. The other preferences indicated in the above paragraphs also apply to the combinations of CDR's mentioned in Table A-1.

Thus, by means of non-limiting examples, a Nanobody of the invention can for example comprise a CDR1 sequence that has more than 80% sequence identity with one of the CDR1 sequences mentioned in Table A-1, a CDR2 sequence that has 3, 2 or 1 amino acid difference with one of the CDR2 sequences mentioned in Table A-1 (but belonging to a different combination), and a CDR3 sequence.

Some preferred Nanobodies of the invention may for example comprise: (1) a CDR1 sequence that has more than 80% sequence identity with one of the CDR1 sequences mentioned in Table A-1; a CDR2 sequence that has 3, 2 or 1 amino acid difference with one of the CDR2 sequences mentioned in Table A-1 (but belonging to a different combination); and a CDR3 sequence that has more than 80% sequence identity with one of the CDR3 sequences mentioned in Table A-1 (but belonging to a different combination); or (2) a CDR1 sequence that has more than 80% sequence identity with one of the CDR1 sequences mentioned in Table A-1; a CDR2 sequence, and one of the CDR3 sequences listed in Table A-1; or (3) a CDR1 sequence; a CDR2 sequence that has more than 80% sequence identity with one of the CDR2 sequence listed in Table A-1; and a CDR3 sequence that has 3, 2 or 1 amino acid differences with the CDR3 sequence mentioned in Table A-1 that belongs to the same combination as the CDR2 sequence.

Some particularly preferred Nanobodies of the invention may for example comprise: (1) a CDR1 sequence that has more than 80% sequence identity with one of the CDR1 sequences mentioned in Table A-1; a CDR2 sequence that has 3, 2 or 1 amino acid difference with the CDR2 sequence mentioned in Table A-1 that belongs to the same combination; and a CDR3 sequence that has more than 80% sequence identity with the CDR3 sequence mentioned in Table A-1 that belongs to the same combination; (2) a CDR1 sequence; a CDR 2 listed in Table A-1 and a CDR3 sequence listed in Table A-1 (in which the CDR2 sequence and CDR3 sequence may belong to different combinations).

Some even more preferred Nanobodies of the invention may for example comprise: (1) a CDR1 sequence that has more than 80% sequence identity with one of the CDR1 sequences mentioned in Table A-1; the CDR2 sequence listed in Table A-1 that belongs to the same combination; and a CDR3 sequence mentioned in Table A-1 that belongs to a different combination; or (2) a CDR1 sequence mentioned in Table A-1; a CDR2 sequence that has 3, 2 or 1 amino acid differences with the CDR2 sequence mentioned in Table A-1 that belongs to the same combination; and a CDR3 sequence that has more than 80% sequence identity with the CDR3 sequence listed in Table A-1 that belongs to the same or a different combination.

Particularly preferred Nanobodies of the invention may for example comprise a CDR1 sequence mentioned in Table A-1, a CDR2 sequence that has more than 80% sequence identity with the CDR2 sequence mentioned in Table A-1 that belongs to the same combination; and the CDR3 sequence mentioned in Table A-1 that belongs to the same combination.

In the most preferred Nanobodies of the invention, the CDR1, CDR2 and CDR3 sequences present are suitably chosen from one of the combinations of CDR1, CDR2 and CDR3 sequences, respectively, listed in Table A-1.

According to another preferred, but non-limiting aspect of the invention (a) CDR1 has a length of between 1 and 12 amino acid residues, and usually between 2 and 9 amino acid residues, such as 5, 6 or 7 amino acid residues; and/or (b) CDR2 has a length of between 13 and 24 amino acid residues, and usually between 15 and 21 amino acid residues, such as 16 and 17 amino acid residues: and/or (c) CDR3 has a length of between 2 and 35 amino acid residues, and usually between 3 and 30 amino acid residues, such as between 6 and 23 amino acid residues.

In another preferred, but non-limiting aspect, the invention relates to a Nanobody in which the CDR sequences (as defined herein) have more than 80%, preferably more than 90%, more preferably more than 95%, such as 99% or more sequence identity (as defined herein) with the CDR sequences of at least one of the amino acid sequences of SEQ ID NO's: 2051-2325.

Generally, Nanobodies with the above CDR sequences may be as further described herein, and preferably have framework sequences that are also as further described herein. Thus, for example and as mentioned herein, such Nanobodies may be naturally occurring Nanobodies (from any suitable species), naturally occurring $V_{HH}$ sequences (i.e. from a suitable species of Camelid) or synthetic or semi-synthetic amino acid sequences or Nanobodies, including but not limited to partially humanized Nanobodies or $V_1$ sequences, fully humanized Nanobodies or $V_{HH}$ sequences, camelized heavy chain variable domain sequences, as well as Nanobodies that have been obtained by the techniques mentioned herein.

Thus, in one specific, but non-limiting aspect, the invention relates to a humanized Nanobody, which consists of 4 framework regions (FR1 to FR4 respectively) and 3 complementarity determining regions (CDR) to CDR3 respectively), in which CDR1 to CDR3 are as defined herein and in which said humanized Nanobody comprises at least one humanizing substitution (as defined herein), and in particular at least one humanizing substitution in at least one of its framework sequences (as defined herein).

In another preferred, but non-limiting aspect, the invention relates to a Nanobody in which the CDR sequences have at least 70% amino acid identity, preferably at least 80% amino acid identity, more preferably at least 90% amino acid identity, such as 95% amino acid identity or more or even essentially 100% amino acid identity with the CDR sequences of at least one of the amino acid sequences of SEQ ID NO's: 2051-2325. This degree of amino acid identity can for example be determined by determining the degree of amino acid identity (in a manner described herein) between said Nanobody and one or more of the sequences of SEQ ID NO's: 2051-2325, in which the amino acid residues that form the framework regions are disregarded. Such Nanobodies can be as further described herein.

In another preferred, but non-limiting aspect, the invention relates to a Nanobody with an amino acid sequence that is chosen from the group consisting of SEQ ID NO's: 2051-2325 or from the group consisting of from amino acid sequences that have more than 80%, preferably more than 90%, more preferably more than 95%, such as 99% or more sequence identity (as defined herein) with at least one of the amino acid sequences of SEQ ID NO's: 2051-2325.

Another preferred, but non-limiting aspect of the invention relates to humanized variants of the Nanobodies of SEQ ID NO's: 2051-2325, that comprise, compared to the corresponding native $V_{HH}$ sequence, at least one humanizing substitution (as defined herein), and in particular at least one humanizing substitution in at least one of its framework sequences (as defined herein).

The polypeptides of the invention comprise or essentially consist of at least one Nanobody of the invention. Some preferred, but non-limiting examples of polypeptides of the invention are given in SEQ ID NO's: 2051-2390.

It will be clear to the skilled person that the Nanobodies that are mentioned herein as "preferred" (or "more preferred", "even more preferred", etc.) are also preferred (or more preferred, or even more preferred, etc.) for use in the polypeptides described herein. Thus, polypeptides that comprise or essentially consist of one or more "preferred" Nanobodies of the invention will generally be preferred, and polypeptides that comprise or essentially consist of one or more "more preferred" Nanobodies of the invention will generally be more preferred, etc.

Generally, proteins or polypeptides that comprise or essentially consist of a single Nanobody (such as a single Nanobody of the invention) will be referred to herein as "monovalent" proteins or polypeptides or as "monovalent constructs". Proteins and polypeptides that comprise or essentially consist of two or more Nanobodies (such as at least two Nanobodies of the invention or at least one Nanobody of the invention and at least one other Nanobody) will be referred to herein as "multivalent" proteins or polypeptides or as "multivalent constructs", and these may provide certain advantages compared to the corresponding monovalent Nanobodies of the invention. Some non-limiting examples of such multivalent constructs will become clear from the further description herein.

According to one specific, but non-limiting aspect, a polypeptide of the invention comprises or essentially consists of at least two Nanobodies of the invention, such as two or three Nanobodies of the invention. As further described herein, such multivalent constructs can provide certain advantages compared to a protein or polypeptide comprising or essentially consisting of a single Nanobody of the invention, such as a much improved avidity for HER2. Such multivalent constructs will be clear to the skilled person based on the disclosure herein: some preferred, but non-limiting examples of such multivalent Nanobody constructs are the constructs of SEQ ID NO's: 2326-2390.

According to another specific, but non-limiting aspect, a polypeptide of the invention comprises or essentially consists of at least one Nanobody of the invention and at least one other binding unit (i.e. directed against another epitope, antigen, target, protein or polypeptide), which is preferably also a Nanobody. Such proteins or polypeptides are also referred to herein as "multispecific" proteins or polypeptides or as "multispecific constructs", and these may provide certain advantages compared to the corresponding monovalent Nanobodies of the invention (as will become clear from the further discussion herein of some preferred, but non-limiting multispecific constructs). Such multispecific constructs will be clear to the skilled person based on the disclosure herein; some preferred, but non-limiting examples of such multispecific Nanobody constructs are the constructs of SEQ ID NO's: 2331-2390.

A multispecific polypeptide or protein comprising or essentially consists of at least one Nanobody of the invention and at least one other binding unit directed against another epitope or antigenic determinant on HER2 (which is preferably also a Nanobody) is also referred to as a "multiparatopic" protein or polypeptide or a "multiparatopic construct".

Some preferred, but non-limiting examples of bivalent monospecific polypeptides of the invention are given in SEQ ID NO's: 2326-2330. Some preferred, but non-limiting examples of bispecific polypeptides of the invention are given in. SEQ ID NO's: 2331-2390. Some preferred, but non-limiting examples of biparatopic polypeptides of the invention are given in SEQ ID NO's: 2336-2390.

According to yet another specific, but non-limiting aspect, a polypeptide of the invention comprises or essentially consists of at least one Nanobody of the invention, optionally one or more further Nanobodies, and at least one other amino acid sequence (such as a protein or polypeptide) that confers at least one desired property to the Nanobody of the invention and/or to the resulting fusion protein. Again, such fusion proteins may provide certain advantages compared to the corresponding monovalent Nanobodies of the invention. Some non-limiting examples of such amino acid sequences and of such fusion constructs will become clear from the further description herein.

It is also possible to combine two or more of the above aspects, for example to provide a trivalent bispecific construct comprising two Nanobodies of the invention and one other Nanobody, and optionally one or more other amino acid sequences. Further non-limiting examples of such constructs, as well as some constructs that are particularly preferred within the context of the present invention, will become clear from the further description herein.

In the above constructs, the one or more Nanobodies and/or other amino acid sequences may be directly linked to each other and/or suitably linked to each other via one or more linker sequences. Some suitable but non-limiting examples of such linkers will become clear from the further description herein.

In one specific aspect of the invention, a Nanobody of the invention or a compound, construct or polypeptide of the invention comprising at least one Nanobody of the invention may have an increased half-life, compared to the corresponding amino acid sequence of the invention. Some preferred, but non-limiting examples of such Nanobodies, compounds and polypeptides will become clear to the skilled person based on the further disclosure herein, and for example comprise Nanobodies sequences or polypeptides of the invention that have been chemically modified to increase the half-life thereof (for example, by means of pegylation); amino acid sequences of the invention that comprise at least one additional binding site for binding to a serum protein (such as serum albumin); or polypeptides of the invention that comprise at least one Nanobody of the invention that is linked to at least one moiety (and in particular at least one amino acid sequence) that increases the half-life of the Nanobody of the invention. Examples of polypeptides of the invention that comprise such half-life extending moieties or amino acid sequences will become clear to the skilled person based on the further disclosure herein; and for example include, without limitation, polypeptides in which the one or more Nanobodies of the invention are suitable linked to one or more serum proteins or fragments thereof (such as serum albumin or suitable fragments thereof) or to one or more binding units that can bind to serum proteins (such as, for example, Nanobodies or (single) domain antibodies that can bind to serum proteins such as serum albumin, serum immunoglobulins such as IgG, or transferrine); polypeptides in which a Nanobody of the invention is linked to an Fc portion (such as a human Fc) or a suitable part or fragment thereof; or polypeptides in which the one or more Nanobodies of the invention are suitable linked to one or more small proteins or peptides that can bind to serum proteins (such as, without limitation, the proteins and peptides described in WO 91/01743, WO 01/45746, WO 02/076489 and to WO 08/068,280 of Ablynx N.V.

Again, as will be clear to the skilled person, such Nanobodies, compounds, constructs or polypeptides may contain one or more additional groups, residues, moieties or binding units, such as one or more further amino acid sequences and in particular one or more additional Nanobodies (i.e. not directed against HER2), so as to provide a tri- or multispecific Nanobody construct. Some preferred, but non-limiting examples of bispecific polypeptides of the invention that bind serum albumin are given in SEQ ID NOs: 2331-2335.

Generally, the Nanobodies of the invention (or compounds, constructs or polypeptides comprising the same) with increased half-life preferably have a half-life that is at least 1.5 times, preferably at least 2 times, such as at least 5 times, for example at least 10 times or more than 20 times, greater than the half-life of the corresponding amino acid sequence of the invention per se. For example, the Nanobodies, compounds, constructs or polypeptides of the invention with increased half-life may have a half-life that is increased with more than 1 hours, preferably more than 2 hours, more preferably more than 6 hours, such as more than 12 hours, or even more than 24, 48 or 72 hours, compared to the corresponding amino acid sequence of the invention per se.

In a preferred, but non-limiting aspect of the invention, such Nanobodies, compound, constructs or polypeptides of the invention exhibit a serum half-life in human of at least about 12 hours, preferably at least 24 hours, more preferably at least 48 hours, even more preferably at least 72 hours or more. For example, compounds or polypeptides of the invention may have a half-life of at least 5 days (such as about 5 to 10 days), preferably at least 9 days (such as about 9 to 14 days), more preferably at least about 10 days (such as about 10 to 15 days), or at least about 11 days (such as about 11 to 16 days), more preferably at least about 12 days (such as about 12 to 18 days or more), or more than 14 days (such as about 14 to 19 days).

In another one aspect of the invention, a polypeptide of the invention comprises one or more (such as two or preferably one) Nanobodies of the invention linked (optionally via one or more suitable linker sequences) to one or more (such as two and preferably one) amino acid sequences that allow the resulting polypeptide of the invention to cross the blood brain barrier. In particular, said one or more amino acid sequences that allow the resulting polypeptides of the invention to cross the blood brain barrier may be one or more (such as two and preferably one) Nanobodies, such as the Nanobodies described in WO 02/057445, of which FC44 (SEQ ID NO: 189 of WO 06/040153) and FC5 (SEQ ID NO: 190 of WO 06/040154) are preferred examples.

In particular, polypeptides comprising one or more Nanobodies of the invention are preferably such that they:

bind to HER2 with a dissociation constant ($K_D$) of $10^{-5}$ to $10^{-12}$ moles/liter or less, and preferably $10^{-7}$ to $10^{-12}$ moles/liter or less and more preferably $10^{-8}$ to $10^{-12}$ moles/liter (i.e. with an association constant ($K_A$) of $10^5$ to $10^{12}$ liter/moles or more, and preferably $10^7$ to $10^{12}$ liter/moles or more and more preferably $10^8$ to $10^{12}$ liter/moles);

and/or such that they:

bind to HER2 with a $k_{on}$-rate of between $10^2$ $M^{-1}$ $s^{-1}$ to about $10^7$ $M^{-1}$ $s^{-1}$, preferably between $10^3$ $M^{-1}$ $s^{-1}$ and $10^7$ $M^{-1}$ $s^{-1}$, more preferably between $10^4$ $M^{-1}$ $s^{-1}$ and $10^7$ $M^{-1}$ $s^{-1}$, such as between $10^5$ $M^{-1}$ $s^{-1}$ and $10^7$ $M^{-1}$ $s^{-1}$;

and/or such that they:

bind to HER2 with a $k_{off}$-rate between 1 $s^{-1}$ ($t_{1/2}$=0.69 s) and $10^{-6}$ $s^{-1}$ (providing a near irreversible complex with a $t_{1/2}$ of multiple days), preferably between $10^{-2}$ $s^{-1}$ and $10^{-6}$ $s^{-1}$, more preferably between $10^{-3}$ $s^{-1}$ and $10^{-6}$ $s^{-1}$, such as between $10^{-4}$ $s^{-1}$ and $10^{-6}$ $s^{-1}$.

Preferably, a polypeptide that contains only one amino acid sequence of the invention is preferably such that it will bind to HER2 with an affinity less than 500 nM, preferably less than 200 nM, more preferably less than 10 nM, such as less than 500 pM. In this respect, it will be clear to the skilled person that a polypeptide that contains two or more Nanobodies of the invention may bind to HER2 with an increased avidity, compared to a polypeptide that contains only one amino acid sequence of the invention.

Some preferred $IC_{50}$ values for binding of the amino acid sequences or polypeptides of the invention to HER2 will become clear from the further description and examples herein.

Other polypeptides according to this preferred aspect of the invention may for example be chosen from the group consisting of amino acid sequences that have more than 80%, preferably more than 90%, more preferably more than 95%, such as 99% or more "sequence identity" (as defined herein) with one or more of the amino acid sequences of SEQ ID NO's: 2326-2390, in which the Nanobodies comprised within said amino acid sequences are preferably as further defined herein.

Particularly preferred amino acid sequences of the invention (including but not limited to Nanobodies) and polypeptides of the invention (including polypeptides that comprise one or more Nanobodies of the invention) are preferably such that they bind to the Herceptin® binding site on HER2 (and in particular domain IV of HER2, more in particular the C-terminus of domain IV of HER2) and/or such that they can compete with Herceptin® for binding to HER-2, and also:

bind to HER2 with a dissociation constant ($K_D$) of $10^{-5}$ to $10^{-12}$ moles/liter or less, and preferably $10^{-7}$ to $10^{-12}$ moles/liter or less and more preferably $10^{-8}$ to $10^{-12}$ moles/liter (i.e. with an association constant ($K_A$) of $10^5$ to $10^{12}$ liter/moles or more, and preferably $10^7$ to $10^{12}$ liter/moles or more and more preferably $10^8$ to $10^{12}$ liter/moles);

and/or such that they:

bind to HER2 with a $k_{on}$-rate of between $10^2$ $M^{-1}$ $s^{-1}$ to about $10^7$ $M^{-1}$ $s^{-1}$, preferably between $10^3$ $M^{-1}$ $s^{-1}$ and $10^7$ $M^{-1}$ $s^{-1}$, more preferably between $10^4$ $M^{-1}$ $s^{-1}$ and $10^7$ $M^{-1}$ $s^{-1}$, such as between $10^5$ $M^{-1}$ $s^{-1}$ and $10^7$ $M^{-1}$ $s^{-1}$;

and/or such that they:

bind to HER2 with a $k_{off}$-rate between 1 $s^{-1}$ ($t_{1/2}$=0.69 s) and $10^{-6}$ $s^{-1}$ (providing a near irreversible complex with a $t_{1/2}$ of multiple days), preferably between $10^{-2}$ $s^{-1}$ and $10^{-6}$ $s^{-1}$, more preferably between $10^{-3}$ $s^{-1}$ and $10^{-6}$ $s^{-1}$, such as between $10^{-4}$ $s^{-1}$ and $10^{-6}$ $s^{-1}$.

Other particularly preferred amino acid sequences of the invention (including but not limited to Nanobodies) and polypeptides of the invention (including polypeptides that comprise one or more Nanobodies of the invention) are preferably such that they bind to the Omnitarg binding site on HER2 (and may in particular domain II of HER2, more in particular the middle of domain II of HER2) and/or such that they can compete with Omnitarg (or the Omnitarg Fab used in Example 9) for binding to HER-2, and also:

bind to HER2 with a dissociation constant ($K_D$) of $10^{-5}$ to $10^{-12}$ moles/liter or less, and preferably $10^{-7}$ to $10^{-12}$ moles/liter or less and more preferably $10^{-8}$ to $10^{-12}$ moles/liter (i.e. with an association constant ($K_A$) of $10^5$ to $10^{12}$ liter/moles or more, and preferably $10^7$ to $10^{12}$ liter/moles or more and more preferably $10^8$ to $10^{12}$ liter/moles);

and/or such that they:

bind to HER2 with a $k_{on}$-rate of between $10^2$ $M^{-1}$ $s^{-1}$ to about $10^7$ $M^{-1}$ $s^{-1}$ preferably between $10^3$ $M^{-1}$ $s^{-1}$ and $10^7$ $M^{-1}$ $s^{-1}$, more preferably between $10^4$ $M^{-1}$ $s^{-1}$ and $10^7$ $M^{-1}$ $s^{-1}$, such as between $10^5$ $M^{-1}$ $s^{-1}$ and $10^7$ $M^{-1}$ $s^{-1}$;

and/or such that they:

bind to HER2 with a $k_{off}$-rate between $s^{-1}$ ($t_{1/2}$=0.69 s) and $10^{-6}$ $s^{-1}$ (providing a near irreversible complex with a $t_{1/2}$ of multiple days), preferably between $10^{-2}$ $s^{-1}$ and $10^{-6}$ $s^{-1}$, more preferably between $10^{-3}$ $s^{-1}$ and $10^{-6}$ $s^{-1}$, such as between $10^{-4}$ $s^{-1}$ and $10^{-6}$ $s^{-1}$.

Some specifically particularly preferred polypeptides of the invention (including polypeptides that comprise one or more Nanobodies of the invention) are preferably such that they (i) bind to the Omnitarg binding site on HER2 (and may in particular domain II of HER2, more in particular the middle of domain II of HER2) and/or can compete with Omnitarg (or the Omnitarg Fab used in Example 9) for binding to HER-2, and (ii) bind to the Herceptin® binding site on HER2 (and in particular domain IV of HER2, more in particular the C-terminus of domain IV of HER2) and/or can compete with Herceptin® for binding to HER-2, and (iii) also:

bind to HER2 with a dissociation constant ($K_D$) of $10^{-5}$ to $10^{-12}$ moles/liter or less, and preferably $10^{-7}$ to $10^{-12}$ moles/liter or less and more preferably $10^{-8}$ to $10^{-12}$ moles/liter (i.e. with an association constant ($K_A$) of $10^5$ to $10^{12}$ liter/moles or more, and preferably $10^7$ to $10^{12}$ liter/moles or more and more preferably $10^8$ to $10^{12}$ liter/moles);

and/or such that they:

bind to HER2 with a $k_{on}$-rate of between $10^2$ $M^{-1}$ $s^{-1}$ to about $10^7$ $M^{-1}$ $s^{-1}$, preferably between $10^3$ $M^{-1}$ $s^{-1}$ and $10^7$ $M^{-1}$ $s^{-1}$, more preferably between $10^4$ $M^{-1}$ $s^{-1}$ and $10^7$ $M^{-1}$ $s^{-1}$, such as between $10^5$ $M^{-1}$ $s^{-1}$ and $10^7$ $M^{-1}$ $s^{-1}$;

and/or such that they:

bind to HER2 with a $k_{off}$ rate between $1$ $s^{-1}$ ($t_{1/2}$=0.69 s) and $10^{-6}$ $s^{-1}$ (providing a near irreversible complex with a $t_{1/2}$ of multiple days), preferably between $10^{-2}$ $s^{-1}$ and $10^{-6}$ $s^{-1}$, more preferably between $10^{-3}$ $s^{-1}$ and $10^{-6}$ $s^{-1}$, such as between $10^{-4}$ $s^{-1}$ and $10^{-6}$ $s^{-1}$.

Another aspect of this invention relates to a nucleic acid that encodes an amino acid sequence of the invention (such as a Nanobody of the invention) or a polypeptide of the invention comprising the same. Again, as generally described herein for the nucleic acids of the invention, such a nucleic acid may be in the form of a genetic construct, as defined herein.

In another aspect, the invention relates to host or host cell that expresses or that is capable of expressing an amino acid sequence of the invention (such as a Nanobody) and/or a polypeptide of the invention comprising the same; and/or that contains a nucleic acid of the invention. Some preferred but non-limiting examples of such hosts or host cells will become clear from the further description herein.

Another aspect of the invention relates to a product or composition containing or comprising at least one amino acid of the invention (such as a Nanobody), at least one polypeptide of the invention and/or at least one nucleic acid of the invention, and optionally one or more further components of such compositions known per se, i.e. depending on the intended use of the composition. Such a product or composition may for example be a pharmaceutical composition (as described herein), a veterinary composition or a product or composition for diagnostic use (as also described herein). Some preferred but non-limiting examples of such products or compositions will become clear from the further description herein.

The invention further relates to methods for preparing or generating the amino acid sequences, compounds, constructs, polypeptides, nucleic acids, host cells, products and compositions described herein. Some preferred but non-limiting examples of such methods will become clear from the further description herein.

The invention further relates to applications and uses of the amino acid sequences, compounds, constructs, polypeptides, nucleic acids, host cells, products and compositions described herein, as well as to methods for the prevention and/or treatment for diseases and disorders associated with HER2. Some preferred but non-limiting applications and uses will become clear from the further description herein.

Other aspects, embodiments, advantages and applications of the invention will also become clear from the further description hereinbelow.

Generally, it should be noted that the term Nanobody as used herein in its broadest sense is not limited to a specific biological source or to a specific method of preparation. For example, as will be discussed in more detail below, the Nanobodies of the invention can generally be obtained: (1) by isolating the $V_{HH}$ domain of a naturally occurring heavy chain antibody; (2) by expression of a nucleotide sequence encoding a naturally occurring $V_{HH}$ domain; (3) by "humanization" (as described herein) of a naturally occurring $V_{HH}$ domain or by expression of a nucleic acid encoding a such humanized $V_{HH}$ domain; (4) by "camelization" (as described herein) of a naturally occurring $V_H$ domain from any animal species, and in particular a from species of mammal, such as from a human being, or by expression of a nucleic acid encoding such a camelized $V_H$ domain; (5) by "camelisation" of a "domain antibody" or "Dab" as described by Ward et al (supra), or by expression of a nucleic acid encoding such a camelized $V_H$ domain; (6) by using synthetic or semi-synthetic techniques for preparing proteins, polypeptides or other amino acid sequences known per se; (7) by preparing a nucleic acid encoding a Nanobody using techniques for nucleic acid synthesis known per se, followed by expression of the nucleic acid thus obtained; and/or (8) by any combination of one or more of the foregoing. Suitable methods and techniques for performing the foregoing will be clear to the skilled person based on the disclosure herein and for example include the methods and techniques described in more detail herein.

One preferred class of Nanobodies corresponds to the $V_{HH}$ domains of naturally occurring heavy chain antibodies directed against HER2. As further described herein, such $V_{HH}$ sequences can generally be generated or obtained by suitably immunizing a species of Camelid with HER2 (i.e. so as to raise an immune response and/or heavy chain antibodies directed against HER2), by obtaining a suitable biological sample from said Camelid (such as a blood sample, serum sample or sample of B-cells), and by generating $V_{HH}$ sequences directed against HER2, starting from said sample, using any suitable technique known per se. Such techniques will be clear to the skilled person and/or are further described herein.

Alternatively, such naturally occurring $V_{HH}$ domains against HER2, can be obtained from naïve libraries of Camelid $V_{HH}$ sequences, for example by screening such a library using HER2, or at least one part, fragment, antigenic determinant or epitope thereof using one or more screening techniques known per se. Such libraries and techniques are for example described in WO 99/37681, WO 01/90190, WO 03/025020 and WO 03/035694. Alternatively, improved synthetic or semi-synthetic libraries derived from naïve $V_{HH}$ libraries may be used, such as $V_{HH}$ libraries obtained from naïve $V_{HH}$ libraries by techniques such as random mutagenesis and/or CDR shuffling, as for example described in WO 00/43507.

Thus, in another aspect, the invention relates to a method for generating Nanobodies, that are directed against HER2. In one aspect, said method at least comprises the steps of:

a) providing a set, collection or library of Nanobody sequences; and b) screening said set, collection or library of Nanobody sequences for Nanobody sequences that can bind to and/or have affinity for HER2;

and c) isolating the amino Nanobody or Nanobodies that can bind to and/or have affinity for HER2.

In such a method, the set, collection or library of Nanobody sequences may be a naïve set, collection or library of Nanobody sequences; a synthetic or semi-synthetic set, collection or library of Nanobody sequences; and/or a set, collection or library of Nanobody sequences that have been subjected to affinity maturation.

In a preferred aspect of this method, the set, collection or library of Nanobody sequences may be an immune set, collection or library of Nanobody sequences, and in particular an immune set, collection or library of $V_{HH}$ sequences, that have been derived from a species of Camelid that has been suitably immunized with HER2 or with a suitable antigenic determinant based thereon or derived therefrom, such as an antigenic part, fragment, region, domain, loop or other epitope thereof. In one particular aspect, said antigenic determinant may be an extracellular part, region, domain, loop or other extracellular epitope(s).

In the above methods, the set, collection or library of Nanobody or $V_{HH}$ sequences may be displayed on a phage, phagemid, ribosome or suitable micro-organism (such as yeast), such as to facilitate screening. Suitable methods, techniques and host organisms for displaying and screening (a set, collection or library of) Nanobody sequences will be clear to the person skilled in the art, for example on the basis of the further disclosure herein. Reference is also made to WO 03/054016 and to the review by Hoogenboom in Nature Biotechnology, 23, 9, 1105-1116 (2005).

In another aspect, the method for generating Nanobody sequences comprises at least the steps of:
a) providing a collection or sample of cells derived from a species of Camelid that express immunoglobulin sequences;
b) screening said collection or sample of cells for (i) cells that express an immunoglobulin sequence that can bind to and/or have affinity for HER2; and (ii) cells that express heavy chain antibodies, in which substeps (i) and (ii) can be performed essentially as a single screening step or in any suitable order as two separate screening steps, so as to provide at least one cell that expresses a heavy chain antibody that can bind to and/or has affinity for HER2;
and
c) either (1) isolating from said cell the $V_{HH}$ sequence present in said heavy chain antibody; or (ii) isolating from said cell a nucleic acid sequence that encodes the $V_{HH}$ sequence present in said heavy chain antibody, followed by expressing said $V_{HH}$ domain.

In the method according to this aspect, the collection or sample of cells may for example be a collection or sample of B-cells. Also, in this method, the sample of cells may be derived from a Camelid that has been suitably immunized with HER2 or a suitable antigenic determinant based thereon or derived therefrom, such as an antigenic part, fragment, region, domain, loop or other epitope thereof. In one particular aspect, said antigenic determinant may be an extracellular part, region, domain, loop or other extracellular epitope(s).

The above method may be performed in any suitable manner, as will be clear to the skilled person. Reference is for example made to EP 0 542 810, WO 05/19824, WO 04/051268 and WO 04/106377. The screening of step b) is preferably performed using a flow cytometry technique such as FACS. For this, reference is for example made to Lieby et al., Blood, Vol. 97, No. 12, 3820. Particular reference is made to the so-called "Nanoclone®" technique described in International application WO 06/079372 by Ablynx N.V.

In another aspect, the method for generating an amino acid sequence directed against HER2 may comprise at least the steps of:
a) providing a set, collection or library of nucleic acid sequences encoding heavy chain antibodies or Nanobody sequences;
b) screening said set, collection or library of nucleic acid sequences for nucleic acid sequences that encode a heavy chain antibody or a Nanobody sequence that can bind to and/or has affinity for HER2;
and
c) isolating said nucleic acid sequence, followed by expressing the $V_{HH}$ sequence present in said heavy chain antibody or by expressing said Nanobody sequence, respectively.

In such a method, the set, collection or library of nucleic acid sequences encoding heavy chain antibodies or Nanobody sequences may for example be a set, collection or library of nucleic acid sequences encoding a naïve set, collection or library of heavy chain antibodies or $V_{HH}$ sequences; a set, collection or library of nucleic acid sequences encoding a synthetic or semi-synthetic set, collection or library of Nanobody sequences; and/or a set, collection or library of nucleic acid sequences encoding a set, collection or library of Nanobody sequences that have been subjected to affinity maturation.

In a preferred aspect of this method, the set, collection or library of nucleic acid sequences may be an immune set, collection or library of nucleic acid sequences encoding heavy chain antibodies or $V_{HH}$ sequences derived from a Camelid that has been suitably immunized with HER2 or with a suitable antigenic determinant based thereon or derived therefrom, such as an antigenic part, fragment, region, domain, loop or other epitope thereof. In one particular aspect, said antigenic determinant may be an extracellular part, region, domain, loop or other extracellular epitope(s).

In the above methods, the set, collection or library of nucleotide sequences may be displayed on a phage, phagemid, ribosome or suitable micro-organism (such as yeast), such as to facilitate screening. Suitable methods, techniques and host organisms for displaying and screening (a set, collection or library of) nucleotide sequences encoding amino acid sequences will be clear to the person skilled in the art, for example on the basis of the further disclosure herein. Reference is also made to WO 03/054016 and to the review by Hoogenboom in Nature Biotechnology, 23, 9, 1105-1116 (2005).

Also encompassed within the present invention are methods for preparing and generating multiparatopic (such as e.g. biparatopic, triparatopic, etc.) amino acids of the invention.

Without being limiting, a method for preparing and generating biparatopic amino acids of the invention may comprise at least the steps of:
a) providing a nucleic acid sequence encoding an HER2 binding amino acid sequence fused to a set, collection or library of nucleic acid sequences encoding amino acid sequences;
b) screening said set, collection or library of nucleic acid sequences for nucleic acid sequences that encode an amino acid sequence that can bind to and/or has affinity for an antigenic determinant on HER2 different from the antigenic determinant recognized by the HER2 binding amino acid sequence;
and
c) isolating the nucleic acid sequence encoding an HER2 binding amino acid sequence fused to the nucleic acid sequence obtained in b), followed by expressing the encoded amino acid sequence.

The biparatopic amino acid sequence obtained in the method above, can subsequently be fused to one or more further sets, collections or libraries of nucleic acid sequences encoding amino acid sequences and again screened for nucleic acid sequences that encode an amino acid sequence that can bind to and/or has affinity for an antigenic determinant on HER2 different from the antigenic determinant of the HER2 binding amino acid sequence and the antigenic determinant of b) in order to obtain a triparatopic or multiparatopic amino acid sequence respectively.

In such a method, the set, collection or library of nucleic acid sequences encoding amino acid sequences may for example be a set, collection or library of nucleic acid sequences encoding a naïve set, collection or library of immunoglobulin sequences; a set, collection or library of nucleic acid sequences encoding a synthetic or semi-synthetic set, collection or library of immunoglobulin sequences; and/or a set, collection or library of nucleic acid sequences encoding a set, collection or library of immunoglobulin sequences that have been subjected to affinity maturation.

Also, in such a method, the set, collection or library of nucleic acid sequences may encode a set, collection or library of heavy chain variable domains (such as $V_H$ domains or $V_{HH}$ domains) or of light chain variable domains. For example, the set, collection or library of nucleic acid sequences may encode a set, collection or library of domain antibodies or single domain antibodies, or a set, collection or library of amino acid sequences that are capable of functioning as a domain antibody or single domain antibody.

In a preferred aspect of this method, the set, collection or library of amino acid sequences may be an immune set, collection or library of nucleic acid sequences, for example derived from a mammal that has been suitably immunized with HER2 or with a suitable antigenic determinant based thereon or derived therefrom, such as an antigenic part, fragment, region, domain, loop or other epitope thereof. In one particular aspect, said antigenic determinant may be an extracellular part, region, domain, loop or other extracellular epitope(s).

The set, collection or library of nucleic acid sequences may for example encode an immune set, collection or library of heavy chain variable domains or of light chain variable domains. In one specific aspect, the set, collection or library of nucleotide sequences may encode a set, collection or library of $V_{HH}$ sequences.

In the above methods, the nucleic acid sequence encoding an HER2 binding amino acid sequence fused to the set, collection or library of nucleotide sequences may be displayed on a phage, phagemid, ribosome or suitable micro-organism (such as yeast), such as to facilitate screening. Suitable methods, techniques and host organisms for displaying and screening (a set, collection or library of) nucleotide sequences encoding amino acid sequences will be clear to the person skilled in the art, for example on the basis of the further disclosure herein. Reference is also made to the review by Hoogenboom in Nature Biotechnology, 23, 9, 1105-1116 (2005).

According to a particularly preferred aspect, a method for preparing and generating biparatopic amino acids of the invention may comprise at least the steps of:
a) providing a set, collection or library of nucleic acid sequences, in which each nucleic acid sequence in said set, collection or library encodes a fusion protein that comprises a first amino acid sequence that can bind to and/or has affinity for a first antigenic determinant, part, domain or epitope on HER2 that is fused (optionally via a linker sequence) to a second amino acid sequence, in which essentially each second amino acid sequence (or most of these) is a different member of a set, collection or library of different amino acid sequences;
b) screening said set, collection or library of nucleic acid sequences for nucleic acid sequences that encode an amino acid sequence that can bind to and/or has affinity for a second antigenic determinant, part, domain or epitope on HER2 different from the first antigenic determinant, part, domain or epitope on HER-2;
and
c) isolating the nucleic acid sequences that encode an amino acid sequence that can bind to and/or has affinity for a second antigenic determinant, part, domain or epitope on HER2 different from the first antigenic determinant, part, domain or epitope on HER-2, obtained in b), optionally followed by expressing the encoded amino acid sequence.

In this preferred method, the first amino acid sequence in the fusion protein encoded by said set collection or library of nucleic acid sequences may be the same amino acid sequence for all members of the set, collection or library of nucleic acid sequences encoding the fusion protein; or the first amino acid sequence in the fusion protein encoded by said set collection or library of nucleic acid sequences may also be a member of a set collection or library of different amino acid sequences.

Again, in such a method, the set, collection or library of nucleic acid sequences encoding amino acid sequences may for example be a set, collection or library of nucleic acid sequences encoding a naïve set, collection or library of immunoglobulin sequences; a set, collection or library of nucleic acid sequences encoding a synthetic or semi-synthetic set, collection or library of immunoglobulin sequences; and/or a set, collection or library of nucleic acid sequences encoding a set, collection or library of immunoglobulin sequences that have been subjected to affinity maturation.

Also, in such a method, the set, collection or library of nucleic acid sequences may encode a set, collection or library of heavy chain variable domains (such as $V_H$ domains or $V_{HH}$ domains) or of light chain variable domains. For example, the set, collection or library of nucleic acid sequences may encode a set, collection or library of domain antibodies or single domain antibodies, or a set, collection or library of amino acid sequences that are capable of functioning as a domain antibody or single domain antibody.

In a preferred aspect of this method, the set, collection or library of amino acid sequences may be an immune set, collection or library of nucleic acid sequences, for example derived from a mammal that has been suitably immunized with HER2 or with a suitable antigenic determinant based thereon or derived therefrom, such as an antigenic part, fragment, region, domain, loop or other epitope thereof. In one particular aspect, said antigenic determinant may be an extracellular part, region, domain, loop or other extracellular epitope(s).

The set, collection or library of nucleic acid sequences may for example encode an immune set, collection or library of heavy chain variable domains or of light chain variable domains. In one specific aspect, the set, collection or library of nucleotide sequences may encode a set, collection or library of $V_{HH}$ sequences.

In the above methods, the nucleic acid sequence encoding an HER2 binding amino acid sequence fused to the set, collection or library of nucleotide sequences may be displayed on a phage, phagemid, ribosome or suitable micro-organism (such as yeast), such as to facilitate screening. Suitable methods, techniques and host organisms for displaying and screening (a set, collection or library of) nucleotide sequences encoding amino acid sequences will be clear to the person skilled in the art, for example on the basis of the further disclosure herein. Reference is also made to the review by Hoogenboom in Nature Biotechnology, 23, 9, 1105-1116 (2005).

In step b), the set, collection or library of nucleic acid sequences may also be screened for nucleic acid sequences that encode an amino acid sequence that can bind to and/or has affinity for both the first antigenic determinant, part, domain or epitope on HER2 and the second antigenic determinant, part, domain or epitope on HER2. This may for example be performed in a subsequent steps (i.e. by in a first step screening or selecting for nucleic acid sequences that encode an amino acid sequence that can bind to and/or has affinity for the second antigenic determinant, part, domain or epitope on HER2, and subsequently in a second step selecting or screening for nucleic acid sequences that encode an amino acid sequence that can bind to and/or has affinity for the first antigenic determinant, part, domain or epitope on HER2; or visa versa) or in a single step (i.e. by simultaneously screening or selecting for nucleic acid sequences that encode an amino acid sequence that can bind to and/or has affinity for both the first antigenic determinant, part, domain or epitope on HER2 and the second antigenic determinant, part, domain or epitope on HER2).

In a preferred aspect of the above method, the first amino acid sequence used in step a) is preferably such that (i) it can bind to and/or has affinity for the Herceptin® binding site on HER2 (and may in particular be directed against domain IV of HER2, more in particular the C-terminus of domain IV of HER2) and/or (ii) competes with Herceptin® for binding to HER-2; and in step b), the set, collection or library of nucleic acid sequences is screened for nucleic acid sequences that encode (i) an amino acid sequence that can bind to and/or has affinity for the Omnitarg binding site on HER2 (and may in particular domain II of HER2, more in particular the middle of domain II of HER2) and/or (ii) an amino acid sequence that can compete with Omnitarg (or the Omnitarg Fab used in Example 9) for binding to HER-2.

Alternatively, the first amino acid sequence used in step a) is preferably such that (i) it can bind to and/or has affinity for the Omnitarg binding site on HER2 (and may in particular domain II of HER2, more in particular the middle of domain II of HER2) and/or (ii) competes with Omnitarg for binding to HER-2; and in step b), the set, collection or library of nucleic acid sequences is screened for nucleic acid sequences that encode (i) an amino acid sequence that can bind to and/or has affinity for the Herceptin® binding site on HER2 (and in particular domain IV of HER2, more in particular the C-terminus of domain IV of HER2) and/or (ii) an amino acid sequence that can compete with Herceptin® for binding to HER-2.

In the above methods, screening or selecting for (nucleic acid sequences that encode) amino acid sequences that compete with Herceptin® or Omnitarg, respectively, may be performed using generally known methods for screening or selecting for competitors of known binding molecules, which may for example involve performing the screening or selection in the presence of the binding molecule and/or determining the binding affinity of the compound(s) to be screened in the presence of the binding molecule.

It is also possible, in step b), to screen for nucleic acid sequences that both (i) encode an amino acid sequence that can bind to and/or has affinity for the Omnitarg binding site on HER2 (and in particular domain II of HER2, more in particular the middle of domain II of HER2) and/or that can compete with Omnitarg® (or the Omnitarg Fab used in Example 9) for binding to HER-2; and that also (ii) encode an amino acid sequence that can bind to and/or has affinity for the Herceptin® binding site on HER2 (and in particular domain IV of HER2, more in particular the C-terminus of domain IV of HER2) and/or that can compete with Herceptin® for binding to HER-2. Again, this may be performed in separate steps or a single step, and by selecting or screening in the presence of Herceptin® and/or Omnitarg, as applicable.

It will also be clear to the skilled person that the above methods may be performed by screening a set, collection or library of amino acid sequences that correspond to (e.g. are encoded by) the nucleic acid sequences used in the above method; and such methods form further aspects of the invention.

The invention in a further aspect provides a method for preparing and generating biparatopic amino acids of the invention which comprises at least the steps of:

a) providing a set, collection or library of nucleic acid sequences, in which each nucleic acid sequence in said set, collection or library encodes a fusion protein that comprises a first amino acid sequence that can bind to and/or has affinity for a first antigenic determinant, part, domain or epitope on HER2 that is fused via a linker sequence to a second amino acid sequence that has can bind to and/or has affinity for a second antigenic determinant, part, domain or epitope on HER2 (which may be the same or different as the first antigenic determinant, part, domain or epitope on HER2), in which essentially each nucleic acid sequence (or most of these) encodes a fusion protein with a different linker sequence so as to provide a set, collection or library encoding different fusion proteins;

b) screening said set, collection or library of nucleic acid sequences for nucleic acid sequences that encode an amino acid sequence that can bind to and/or has affinity for the first and second antigenic determinant, part, domain or epitope on HER2;

and c) isolating the nucleic acid sequences that encode an amino acid sequence that can bind to and/or has affinity for the first and second antigenic determinant, part, domain or epitope on HER2, optionally followed by expressing the encoded amino acid sequence.

As will be clear to the skilled person, this method can be used to screen for suitable or even optimal linker lengths for linking the first and second amino acid sequence. For example, in this aspect, the first amino acid sequence may be an amino acid sequence that can bind to and/or has affinity for the Omnitarg binding site on HER2 (and may in particular domain II of HER2, more in particular the middle of domain II of HER2) and/or that can compete with Omnitarg (or the Omnitarg Fab used in Example 9); and the second amino acid sequence may be an amino acid sequence that can bind to and/or has affinity for the Herceptin® binding site on HER2 (and in particular domain IV of HER2, more in particular the C-terminus of domain IV of HER2) and/or that can compete with Herceptin® for binding to HER-2 (or visa versa). The screening and selection step b) may be performed as further described above.

Another method for preparing and generating biparatopic amino acids of the invention may comprise at least the steps of:

a) providing a set, collection or library of nucleic acid sequences encoding amino acid sequences;

b) screening said set, collection or library of nucleic acid sequences for a set, collection or library of nucleic acid sequences that encode an amino acid sequence that can bind to and/or has affinity for HER2;

c) ligating said set, collection or library of nucleic acid sequences that encode an amino acid sequence that can bind to and/or has affinity for HER2 to another nucleic acid sequence that encodes an amino acid sequence that can bind to and/or has affinity for HER2 (e.g. a nucleic acid sequence that encodes an amino acid sequence that competes with Herceptin® for binding HER2);

and d) from the set, collection or library of nucleic acid sequences obtained in c), isolating the nucleic acid sequences encoding a biparatopic amino acid sequence that can bind to and/or has affinity for HER2 (and e.g. further selecting for nucleic acid sequences that encode a biparatopic amino acid sequence that antagonizes with higher potency compared to the monovalent amino acid sequences), followed by expressing the encoded amino acid sequence.

The biparatopic amino acid sequence obtained in the method above, can subsequently be fused to one or more further sets, collections or libraries of nucleic acid sequences encoding amino acid sequences that can bind to and/or have affinity for HER2 in order to obtain a triparatopic or multiparatopic amino acid sequence respectively.

In such a method, the set, collection or library of nucleic acid sequences encoding amino acid sequences may for example be a set, collection or library of nucleic acid sequences encoding a naïve set, collection or library of immunoglobulin sequences; a set, collection or library of nucleic acid sequences encoding a synthetic or semi-synthetic set, collection or library of immunoglobulin sequences; and/or a set, collection or library of nucleic acid sequences encoding a set, collection or library of immunoglobulin sequences that have been subjected to affinity maturation.

The set, collection or library of nucleic acid sequences that encode an amino acid sequence that can bind to and/or has affinity for HER2 can be obtained by any selection or screening method known in the art for the selection and/or screening of nucleic acid sequences that encode an amino acid sequence that can bind to and/or has affinity for HER2 and as, for example, described in the Examples section.

Also, in such a method, the set, collection or library of nucleic acid sequences may encode a set, collection or library of heavy chain variable domains (such as $V_H$ domains or $V_{HH}$ domains) or of light chain variable domains. For example, the set, collection or library of nucleic acid sequences may encode a set, collection or library of domain antibodies or single domain antibodies, or a set, collection or library of amino acid sequences that are capable of functioning as a domain antibody or single domain antibody.

In a preferred aspect of this method, the set, collection or library of amino acid sequences may be an immune set, collection or library of nucleic acid sequences, for example derived from a mammal that has been suitably immunized with HER2 or with a suitable antigenic determinant based thereon or derived therefrom, such as an antigenic part, fragment, region, domain, loop or other epitope thereof. In one particular aspect, said antigenic determinant may be an extracellular part, region, domain, loop or other extracellular epitope(s).

The set, collection or library of nucleic acid sequences may for example encode an immune set, collection or library of heavy chain variable domains or of light chain variable domains. In one specific aspect, the set, collection or library of nucleotide sequences may encode a set, collection or library of $V_{HH}$ sequences.

In the above methods, the nucleic acid sequence may be displayed on a phage, phagemid, ribosome or suitable microorganism (such as yeast), such as to facilitate screening. Suitable methods, techniques and host organisms for displaying and screening (a set, collection or library of) nucleotide sequences encoding amino acid sequences will be clear to the person skilled in the art, for example on the basis of the further disclosure herein. Reference is also made to the review by Hoogenboom in Nature Biotechnology, 23, 9, 1105-1116 (2005).

Another method for preparing and generating biparatopic amino acids of the invention may comprise at least the steps of:

a) providing a first set, collection or library of nucleic acid sequences encoding amino acid sequences;

b) screening said first set, collection or library of nucleic acid sequences for a nucleic acid sequence that encodes an amino acid sequence that can bind to and/or has affinity for a first antigenic determinant, part, domain or epitope on HER2;

c) ligating the nucleic acid sequence encoding said amino acid sequence that can bind to and/or has affinity for a first antigenic determinant, part, domain or epitope on HER2 to another set, collection or library of nucleic acid sequences encoding amino acid sequences to obtain a set, collection or library of nucleic acid sequences that encode fusion proteins;

d) screening said set, collection or library of nucleic acid sequences obtained in step c) for a nucleic acid sequence that encodes an amino acid sequence that can bind a second antigenic determinant, part, domain or epitope on HER2 different from the first antigenic determinant, part, domain or epitope on HER-2;

and e) isolating the nucleic acid sequence that encodes an amino acid sequence that can bind to and/or has affinity for the first and second antigenic determinant, part, domain or epitope on HER2, optionally followed by expressing the encoded amino acid sequence.

In a preferred aspect of the above method, the first amino acid sequence used in step a) is preferably such that (i) it can bind to and/or has affinity for the Herceptin® binding site on HER2 (and may in particular be directed against domain IV of HER2, more in particular the C-terminus of domain IV of HER2) and/or (ii) competes with Herceptin® for binding to HER-2; and in step b), the set, collection or library of nucleic acid sequences is screened for nucleic acid sequences that encode (i) an amino acid sequence that can bind to and/or has affinity for the Omnitarg binding site on HER2 (and may in particular domain II of HER2, more in particular the middle of domain II of HER2) and/or (ii) an amino acid sequence that can compete with Omnitarg (or the Omnitarg Fab used in Example 9) for binding to HER-2.

Alternatively, the first amino acid sequence used in step a) is preferably such that (i) it can bind to and/or has affinity for the Omnitarg binding site on HER2 (and may in particular domain II of HER2, more in particular the middle of domain II of HER2) and/or (ii) competes with Omnitarg for binding to HER-2; and in step b), the set, collection or library of nucleic acid sequences is screened for nucleic acid sequences that encode (i) an amino acid sequence that can bind to and/or has affinity for the Herceptin® binding site on HER2 (and in particular domain IV of HER2, more in particular the C-terminus of domain IV of HER2) and/or (ii) an amino acid sequence that can compete with Herceptin® for binding to HER-2.

In the above methods, screening or selecting for (nucleic acid sequences that encode) amino acid sequences that compete with Herceptin® or Omnitarg, respectively, may be performed using generally known methods for screening or selecting for competitors of known binding molecules, which may for example involve performing the screening or selection in the presence of the binding molecule and/or determining the binding affinity of the compound(s) to be screened in the presence of the binding molecule.

It is also possible, in step b), to screen for nucleic acid sequences that both (i) encode an amino acid sequence that can bind to and/or has affinity for the Omnitarg binding site on HER2 (and in particular domain II of HER2, more in particular the middle of domain II of HER2) and/or that can compete with Omnitarg (or the Omnitarg Fab used in Example 9) for binding to HER-2; and that also (ii) encode an amino acid sequence that can bind to and/or has affinity for the Herceptin® binding site on HER2 (and in particular domain IV of HER2, more in particular the C-terminus of domain IV of HER2) and/or that can compete with Herceptin® for binding to HER-2. Again, this may be performed in separate steps or a single step, and by selecting or screening in the presence of Herceptin® and/or Omnitarg, as applicable.

The biparatopic amino acid sequence obtained in the method above, can subsequently be fused to one or more further sets, collections or libraries of nucleic acid sequences encoding amino acid sequences that can bind to and/or have affinity for HER2 in order to obtain a triparatopic or multiparatopic amino acid sequence respectively.

In such a method, the set, collection or library of nucleic acid sequences encoding amino acid sequences may for example be a set, collection or library of nucleic acid sequences encoding a naïve set, collection or library of immunoglobulin sequences; a set, collection or library of nucleic acid sequences encoding a synthetic or semi-synthetic set, collection or library of immunoglobulin sequences; and/or a set, collection or library of nucleic acid sequences encoding a set, collection or library of immunoglobulin sequences that have been subjected to affinity maturation.

The set, collection or library of nucleic acid sequences that encode an amino acid sequence that can bind to and/or has affinity for HER2 can be obtained by any selection or screening method known in the art for the selection and/or screening of nucleic acid sequences that encode an amino acid sequence that can bind to and/or has affinity for HER2 and as, for example, described in the Examples section.

Also, in such a method, the set, collection or library of nucleic acid sequences may encode a set, collection or library of heavy chain variable domains (such as $V_H$ domains or $V_{HH}$ domains) or of light chain variable domains. For example, the set, collection or library of nucleic acid sequences may encode a set, collection or library of domain antibodies or single domain antibodies, or a set, collection or library of amino acid sequences that are capable of functioning as a domain antibody or single domain antibody.

In a preferred aspect of this method, the set, collection or library of amino acid sequences may be an immune set, collection or library of nucleic acid sequences, for example derived from a mammal that has been suitably immunized with HER2 or with a suitable antigenic determinant based thereon or derived therefrom, such as an antigenic part, fragment, region, domain, loop or other epitope thereof. In one particular aspect, said antigenic determinant may be an extracellular part, region, domain, loop or other extracellular epitope(s).

The set, collection or library of nucleic acid sequences may for example encode an immune set, collection or library of heavy chain variable domains or of light chain variable domains. In one specific aspect, the set, collection or library of nucleotide sequences may encode a set, collection or library of $V_{HH}$ sequences.

In the above methods, the nucleic acid sequence may be displayed on a phage, phagemid, ribosome or suitable microorganism (such as yeast), such as to facilitate screening. Suitable methods, techniques and host organisms for displaying and screening (a set, collection or library of) nucleotide sequences encoding amino acid sequences will be clear to the person skilled in the art, for example on the basis of the further disclosure herein. Reference is also made to the review by Hoogenboom in Nature Biotechnology, 23, 9, 1105-1116 (2005).

As will be clear to the skilled person, the screening step of the methods described herein can also be performed as a selection step. Accordingly the term "screening" as used in the present description can comprise selection, screening or any suitable combination of selection and/or screening techniques. Also, when a set, collection or library of sequences is used, it may contain any suitable number of sequences, such as 1, 2, 3 or about 5, 10, 50, 100, 500, 1000, 5000, $10^4$, $10^5$, $10^6$, $10^7$, $10^8$ or more sequences.

Also, one or more or all of the sequences in the above set, collection or library of amino acid sequences may be obtained or defined by rational, or semi-empirical approaches such as computer modelling techniques or biostatics or datamining techniques.

Furthermore, such a set, collection or library can comprise one, two or more sequences that are variants from one another (e.g. with designed point mutations or with randomized positions), compromise multiple sequences derived from a diverse set of naturally diversified sequences (e.g. an immune library)), or any other source of diverse sequences (as described for example in Hoogenboom et al. (Nat Biotechnol 23:1105, 2005) and Binz et al. (Nat Biotechnol 2005, 23:1247)). Such set, collection or library of sequences can be displayed on the surface of a phage particle, a ribosome, a bacterium, a yeast cell, a mammalian cell, and linked to the nucleotide sequence encoding the amino acid sequence within these carriers. This makes such set, collection or library amenable to selection procedures to isolate the desired amino acid sequences of the invention. More generally, when a sequence is displayed on a suitable host or host cell, it is also possible (and customary) to first isolate from said host or host cell a nucleotide sequence that encodes the desired sequence, and then to obtain the desired sequence by suitably expressing said nucleotide sequence in a suitable host organism. Again, this can be performed in any suitable manner known per se, as will be clear to the skilled person.

Yet another technique for obtaining $V_{HH}$ sequences or Nanobody sequences directed against HER2 involves suitably immunizing a transgenic mammal that is capable of expressing heavy chain antibodies (i.e. so as to raise an immune response and/or heavy chain antibodies directed against HER2), obtaining a suitable biological sample from said transgenic mammal that contains (nucleic acid sequences encoding) said $V_{HH}$ sequences or Nanobody sequences (such as a blood sample, serum sample or sample of B-cells), and then generating $V_{HH}$ sequences directed against HER2, starting from said sample, using any suitable technique known per se (such as any of the methods described herein or a hybridoma technique). For example, for this purpose, the heavy chain antibody-expressing mice and the further methods and techniques described in WO 02/085945, WO 04/049794 and WO 06/008548 and Janssens et al. (Proc. Natl. Acad. Sci. USA. 2006 Oct. 10; 103(41):15130-5) can be used. For example, such heavy chain antibody expressing mice can express heavy chain antibodies with any suitable (single) variable domain, such as (single) variable domains from natural sources (e.g. human (single) variable domains, Camelid (single) variable domains or shark (single) variable domains), as well as for example synthetic or semi-synthetic (single) variable domains.

The invention also relates to the $V_{HH}$ sequences or Nanobody sequences that are obtained by the above methods, or alternatively by a method that comprises the one of the above methods and in addition at least the steps of determining the nucleotide sequence or amino acid sequence of said $V_{HH}$ sequence or Nanobody sequence; and of expressing or synthesizing said $V_{HH}$ sequence or Nanobody sequence in a manner known per se, such as by expression in a suitable host cell or host organism or by chemical synthesis.

As mentioned herein, a particularly preferred class of Nanobodies of the invention comprises Nanobodies with an amino acid sequence that corresponds to the amino acid sequence of a naturally occurring $V_{HH}$ domain, but that has been "humanized", i.e. by replacing one or more amino acid residues in the amino acid sequence of said naturally occurring $V_{HH}$ sequence (and in particular in the framework sequences) by one or more of the amino acid residues that occur at the corresponding position(s) in a $V_H$ domain from a conventional 4-chain antibody from a human being (e.g. indicated above). This can be performed in a manner known per se, which will be clear to the skilled person, for example on the basis of the further description herein and the prior art on humanization referred to herein. Again, it should be noted that such humanized Nanobodies of the invention can be obtained in any suitable mariner known per se (i.e. as indicated under points (1)-(8) above) and thus are not strictly limited to polypeptides that have been obtained using a polypeptide that comprises a naturally occurring $V_{HH}$ domain as a starting material.

Another particularly preferred class of Nanobodies of the invention comprises Nanobodies with an amino acid sequence that corresponds to the amino acid sequence of a naturally occurring $V_H$ domain, but that has been "camelized", i.e. by replacing one or more amino acid residues in the amino acid sequence of a naturally occurring $V_H$ domain from a conventional 4-chain antibody by one or more of the amino acid residues that occur at the corresponding position(s) in a $V_{HH}$ domain of a heavy chain antibody. This can be performed in a manner known per se, which will be clear to the skilled person, for example on the basis of the further description herein. Such "camelizing" substitutions are preferably inserted at amino acid positions that form and/or are present at the $V_H$-$V_L$ interface, and/or at the so-called Camelidae hallmark residues, as defined herein (see for example WO 94/04678 and Davies and Riechmann (1994 and 1996), supra). Preferably, the $V_1$ sequence that is used as a starting material or starting point for generating or designing the camelized Nanobody is preferably a $V_H$ sequence from a mammal, more preferably the $V_H$ sequence of a human being, such as a $V_H3$ sequence. However, it should be noted that such camelized Nanobodies of the invention can be obtained in any suitable manner known per se (i.e. as indicated under points (1)-(8) above) and thus are not strictly limited to polypeptides that have been obtained using a polypeptide that comprises a naturally occurring $V_H$ domain as a starting material.

For example, again as further described herein, both "humanization" and "camelization" can be performed by providing a nucleotide sequence that encodes a naturally occurring $V_{HH}$ domain or $V_H$ domain, respectively, and then changing, in a manner known per se, one or more codons in said nucleotide sequence in such a way that the new nucleotide sequence encodes a "humanized" or "camelized" Nanobody of the invention, respectively. This nucleic acid can then be expressed in a manner known per se, so as to provide the desired Nanobody of the invention. Alternatively, based on the amino acid sequence of a naturally occurring $V_{HH}$ domain or $V_H$ domain, respectively, the amino acid sequence of the desired humanized or camelized Nanobody of the invention, respectively, can be designed and then synthesized de novo using techniques for peptide synthesis known per se. Also, based on the amino acid sequence or nucleotide sequence of a naturally occurring $V_{HH}$ domain or $V_H$ domain, respectively, a nucleotide sequence encoding the desired humanized or camelized Nanobody of the invention, respectively, can be designed and then synthesized de novo using techniques for nucleic acid synthesis known per se, after which the nucleic acid thus obtained can be expressed in a manner known per se, so as to provide the desired Nanobody of the invention.

Other suitable methods and techniques for obtaining the Nanobodies of the invention and/or nucleic acids encoding the same, starting from naturally occurring $V_H$ sequences or preferably $V_{HH}$ sequences, will be clear from the skilled person, and may for example comprise combining one or more parts of one or more naturally occurring $V_{14}$ sequences (such as one or more FR sequences and/or CDR sequences), one or more parts of one or more naturally occurring $V_{HH}$ sequences (such as one or more FR sequences or CDR sequences), and/or one or more synthetic or semi-synthetic sequences, in a suitable manner, so as to provide a Nanobody of the invention or a nucleotide sequence or nucleic acid encoding the same (which may then be suitably expressed). Nucleotide sequences encoding framework sequences of $V_{HH}$ sequences or Nanobodies will be clear to the skilled person based on the disclosure herein and/or the further prior art cited herein (and/or may alternatively be obtained by PCR starting from the nucleotide sequences obtained using the methods described herein) and may be suitably combined with nucleotide sequences that encode the desired CDR's (for example, by PCR assembly using overlapping primers), so as to provide a nucleic acid encoding a Nanobody of the invention.

As mentioned herein, Nanobodies may in particular be characterized by the presence of one or more "Hallmark residues" (as described herein) in one or more of the framework sequences.

Thus, according to one preferred, but non-limiting aspect of the invention, a Nanobody in its broadest sense can be generally defined as a polypeptide comprising:

a) an amino acid sequence that is comprised of four framework regions/sequences interrupted by three complementarity determining regions/sequences, in which the amino acid residue at position 108 according to the Kabat numbering is Q;

and/or:

b) an amino acid sequence that is comprised of four framework regions/sequences interrupted by three complementarity determining regions/sequences, in which the amino acid residue at position 45 according to the Kabat numbering is a charged amino acid (as defined herein) or a cysteine residue, and position 44 is preferably an E;

and/or:

c) an amino acid sequence that is comprised of four framework regions/sequences interrupted by three complementarity determining regions/sequences, in which the amino acid residue at position 103 according to the Kabat numbering is chosen from the group consisting of P, R and S, and is in particular chosen from the group consisting of R and S.

Thus, in a first preferred, but non-limiting aspect, a Nanobody of the invention may have the structure

FR1-CDR1-FR2-CDR2-FR3-CDR3-FR4 in which FR1 to FR4 refer to framework regions 1 to 4, respectively, and in which CDR1 to CDR3 refer to the complementarity determining regions 1 to 3, respectively, and in which a) the amino acid residue at position 108 according to the Kabat numbering is Q;

and/or in which:
b) the amino acid residue at position 45 according to the Kabat numbering is a charged amino acid or a cysteine and the amino acid residue at position 44 according to the Kabat numbering is preferably E;
and/or in which:
c) the amino acid residue at position 103 according to the Kabat numbering is chosen from the group consisting of P, R and S, and is in particular chosen from the group consisting of R and S;
and in which:
d) CDR1, CDR2 and CDR3 are as defined herein, and are preferably as defined according to one of the preferred aspects herein, and are more preferably as defined according to one of the more preferred aspects herein.

In particular, a Nanobody in its broadest sense can be generally defined as a polypeptide comprising:
a) an amino acid sequence that is comprised of four framework regions/sequences interrupted by three complementarity determining regions/sequences, in which the amino acid residue at position 108 according to the Kabat numbering is Q;
and/or:
b) an amino acid sequence that is comprised of four framework regions/sequences interrupted by three complementarity determining regions/sequences, in which the amino acid residue at position 44 according to the Kabat numbering is E and in which the amino acid residue at position 45 according to the Kabat numbering is an R;
and/or:
c) an amino acid sequence that is comprised of four framework regions/sequences interrupted by three complementarity determining regions/sequences, in which the amino acid residue at position 103 according to the Kabat numbering is chosen from the group consisting of P, R and S, and is in particular chosen from the group consisting of R and S.

Thus, according to a preferred, but non-limiting aspect, a Nanobody of the invention may have the structure
FR1-CDR1-FR2-CDR2-FR3-CDR3-FR4
in which FR1 to FR4 refer to framework regions 1 to 4, respectively, and in which CDR1 to CDR3 refer to the complementarity determining regions 1 to 3, respectively, and in which
a) the amino acid residue at position 108 according to the Kabat numbering is Q;
and/or in which:
b) the amino acid residue at position 44 according to the Kabat numbering is E and in which the amino acid residue at position 45 according to the Kabat numbering is an R;
and/or in which:
c) the amino acid residue at position 103 according to the Kabat numbering is chosen from the group consisting of P, R and S, and is in particular chosen from the group consisting of R and S;
and in which:
d) CDR1, CDR2 and CDR3 are as defined herein, and are preferably as defined according to one of the preferred aspects herein, and are more preferably as defined according to one of the more preferred aspects herein.

In particular, a Nanobody against HER2 according to the invention may have the structure:
FR1-CDR1-FR2-CDR2-FR3-CDR3-FR4
in which FR1 to FR4 refer to framework regions 1 to 4, respectively, and in which CDR1 to CDR3 refer to the complementarity determining regions 1 to 3, respectively, and in which
a) the amino acid residue at position 108 according to the Kabat numbering is Q;
and/or in which:
b) the amino acid residue at position 44 according to the Kabat numbering is E and in which the amino acid residue at position 45 according to the Kabat numbering is an R;
and/or in which:
c) the amino acid residue at position 103 according to the Kabat numbering is chosen from the group consisting of P, R and S, and is in particular chosen from the group consisting of R and S;
and in which:
d) CDR1, CDR2 and CDR3 are as defined herein, and are preferably as defined according to one of the preferred aspects herein, and are more preferably as defined according to one of the more preferred aspects herein.

In particular, according to one preferred, but non-limiting aspect of the invention, a Nanobody can generally be defined as a polypeptide comprising an amino acid sequence that is comprised of four framework regions/sequences interrupted by three complementarity determining regions/sequences, in which:
a-1) the amino acid residue at position 44 according to the Kabat numbering is chosen from the group consisting of A, G, E, D, G, Q, R, S, L; and is preferably chosen from the group consisting of G, E or Q; and
a-2) the amino acid residue at position 45 according to the Kabat numbering is chosen from the group consisting of L, R or C; and is preferably chosen from the group consisting of L or R; and
a-3) the amino acid residue at position 103 according to the Kabat numbering is chosen from the group consisting of W, R or S; and is preferably W or R, and is most preferably W;
a-4) the amino acid residue at position 108 according to the Kabat numbering is Q;
or in which:
b-1) the amino acid residue at position 44 according to the Kabat numbering is chosen from the group consisting of E and Q; and
b-2) the amino acid residue at position 45 according to the Kabat numbering is R; and
b-3) the amino acid residue at position 103 according to the Kabat numbering is chosen from the group consisting of W, R and S; and is preferably W;
b-4) the amino acid residue at position 108 according to the Kabat numbering is chosen from the group consisting of Q and L; and is preferably Q;
or in which:
c-1) the amino acid residue at position 44 according to the Kabat numbering is chosen from the group consisting of A, G, E, D, Q, R, S and L; and is preferably chosen from the group consisting of G, E and Q; and
c-2) the amino acid residue at position 45 according to the Kabat numbering is chosen from the group consisting of L, R and C; and is preferably chosen from the group consisting of L and R; and
c-3) the amino acid residue at position 103 according to the Kabat numbering is chosen from the group consisting of P, R and S; and is in particular chosen from the group consisting of R and S; and
c-4) the amino acid residue at position 108 according to the Kabat numbering is chosen from the group consisting of Q and L; is preferably Q;
and in which
d) CDR1, CDR2 and CDR3 are as defined herein, and are preferably as defined according to one of the preferred aspects herein, and are more preferably as defined according to one of the more preferred aspects herein.

Thus, in another preferred, but non-limiting aspect, a Nanobody of the invention may have the structure
FR1-CDR1-FR2-CDR2-FR3-CDR3-FR4
in which FR1 to FR4 refer to framework regions 1 to 4, respectively, and in which CDR1 to CDR3 refer to the complementarity determining regions 1 to 3, respectively, and in which:
a-1) the amino acid residue at position 44 according to the Kabat numbering is chosen from the group consisting of A, G, E, D, G, Q, R, S, L; and is preferably chosen from the group consisting of G, E or Q;
and in which:
a-2) the amino acid residue at position 45 according to the Kabat numbering is chosen from the group consisting of L, R or C; and is preferably chosen from the group consisting of L or R;
and in which:
a-3) the amino acid residue at position 103 according to the Kabat numbering is chosen from the group consisting of W, R or S; and is preferably W or R, and is most preferably W;
and in which
a-4) the amino acid residue at position 108 according to the Kabat numbering is Q;
and in which:
d) CDR', CDR2 and CDR3 are as defined herein, and are preferably as defined according to one of the preferred aspects herein, and are more preferably as defined according to one of the more preferred aspects herein.

In another preferred, but non-limiting aspect, a Nanobody of the invention may have the structure
FR1-CDR1-FR2-CDR2-FR3-CDR3-FR4
in which FR1 to FR4 refer to framework regions 1 to 4, respectively, and in which CDR1 to CDR3 refer to the complementarity determining regions 1 to 3, respectively, and in which:
b-1) the amino acid residue at position 44 according to the Kabat numbering is chosen from the group consisting of E and Q;
and in which:
b-2) the amino acid residue at position 45 according to the Kabat numbering is R;
and in which:
b-3) the amino acid residue at position 103 according to the Kabat numbering is chosen from the group consisting of W, R and S; and is preferably W;
and in which:
b-4) the amino acid residue at position 108 according to the Kabat numbering is chosen from the group consisting of Q and L; and is preferably Q;
and in which:
d) CDR1, CDR2 and CDR3 are as defined herein, and are preferably as defined according to one of the preferred aspects herein, and are more preferably as defined according to one of the more preferred aspects herein.

In another preferred, but non-limiting aspect, a Nanobody of the invention may have the structure
FR1-CDR1-FR2-CDR2-FR3-CDR3-FR4
in which FR1 to FR4 refer to framework regions 1 to 4, respectively, and in which CDR1 to CDR3 refer to the complementarity determining regions 1 to 3, respectively, and in which:
c-1) the amino acid residue at position 44 according to the Kabat numbering is chosen from the group consisting of A, G, E, D, Q, R, S and L; and is preferably chosen from the group consisting of G, E and Q;
and in which:
c-2) the amino acid residue at position 45 according to the Kabat numbering is chosen from the group consisting of L, R and C; and is preferably chosen from the group consisting of L and R;
and in which:
c-3) the amino acid residue at position 103 according to the Kabat numbering is chosen from the group consisting of P, R and S; and is in particular chosen from the group consisting of R and S;
and in which:
c-4) the amino acid residue at position 108 according to the Kabat numbering is chosen from the group consisting of Q and L; is preferably Q;
and in which:
d) CDR1, CDR2 and CDR3 are as defined herein, and are preferably as defined according to one of the preferred aspects herein, and are more preferably as defined according to one of the more preferred aspects herein.

Two particularly preferred, but non-limiting groups of the Nanobodies of the invention are those according to a) above; according to (a-1) to (a-4) above; according to b) above; according to (b-1) to (b-4) above; according to (c) above; and/or according to (c-1) to (c-4) above, in which either:
i) the amino acid residues at positions 44-47 according to the Kabat numbering form the sequence GLEW (or a GLEW-like sequence as described herein) and the amino acid residue at position 108 is Q;
or in which:
ii) the amino acid residues at positions 43-46 according to the Kabat numbering form the sequence KERE (SEQ ID NO: 2448) or KQRE (SEQ ID NO: 2449) (or a KERE-like sequence as described) and the amino acid residue at position 108 is Q or L, and is preferably Q.

Thus, in another preferred, but non-limiting aspect, a Nanobody of the invention may have the structure
FR1-CDR1-FR2-CDR2-FR3-CDR3-FR4
in which FR1 to FR4 refer to framework regions 1 to 4, respectively, and in which CDR1 to CDR3 refer to the complementarity determining regions 1 to 3, respectively, and in which:
i) the amino acid residues at positions 44-47 according to the Kabat numbering form the sequence GLEW (SEQ ID NO: 2447) (or a GLEW-like sequence as defined herein) and the amino acid residue at position 108 is Q;
and in which:
ii) CDR1, CDR2 and CDR3 are as defined herein, and are preferably as defined according to one of the preferred aspects herein, and are more preferably as defined according to one of the more preferred aspects herein.

In another preferred, but non-limiting aspect, a Nanobody of the invention may have the structure
FR1-CDR1-FR2-CDR2-FR3-CDR3-FR4
in which FR1 to FR4 refer to framework regions 1 to 4, respectively, and in which CDR1 to CDR3 refer to the complementarity determining regions 1 to 3, respectively, and in which:
i) the amino acid residues at positions 43-46 according to the Kabat numbering form the sequence KERE (SEQ ID NO: 2448) or KQRE (SEQ ID NO: 2449) (or a KERE-like sequence) and the amino acid residue at position 108 is Q or L, and is preferably Q;
and in which:
ii) CDR1, CDR2 and CDR3 are as defined herein, and are preferably as defined according to one of the preferred aspects herein, and are more preferably as defined according to one of the more preferred aspects herein.

In the Nanobodies of the invention in which the amino acid residues at positions 43-46 according to the Kabat numbering form the sequence KERE (SEQ ID NO: 2448) or KQRE (SEQ ID NO: 2449), the amino acid residue at position 37 is most preferably F. In the Nanobodies of the invention in which the amino acid residues at positions 44-47 according to the Kabat numbering form the sequence GLEW (SEQ ID NO: 2447), the amino acid residue at position 37 is chosen from the group consisting of Y, H, I, L, V or F, and is most preferably V.

Thus, without being limited hereto in any way, on the basis of the amino acid residues present on the positions mentioned above, the Nanobodies of the invention can generally be classified on the basis of the following three groups:

i) The "GLEW-group": Nanobodies with the amino acid sequence GLEW (SEQ ID NO: 2447) at positions 44-47 according to the Kabat numbering and Q at position 108 according to the Kabat numbering. As further described herein, Nanobodies within this group usually have a V at position 37, and can have a W, P, R or S at position 103, and preferably have a W at position 103. The GLEW group also comprises some GLEW-like sequences such as those mentioned in Table A-3 below. More generally, and without limitation, Nanobodies belonging to the GLEW-group can be defined as Nanobodies with a G at position 44 and/or with a W at position 47, in which position 46 is usually E and in which preferably position 45 is not a charged amino acid residue and not cysteine;

ii) The "KERE-group": Nanobodies with the amino acid sequence KERE (SEQ ID NO: 2448) or KQRE (SEQ ID NO: 2449) (or another KERE-like sequence) at positions 43-46 according to the Kabat numbering and Q or L at position 108 according to the Kabat numbering. As further described herein, Nanobodies within this group usually have a F at position 37, an L or F at position 47; and can have a W, P, R or S at position 103, and preferably have a W at position 103. More generally, and without limitation, Nanobodies belonging to the KERE-group can be defined as Nanobodies with a K, Q or R at position 44 (usually K) in which position 45 is a charged amino acid residue or cysteine, and position 47 is as further defined herein; iii) The "103 P, R, S-group": Nanobodies with a P, R or S at position 103. These Nanobodies can have either the amino acid sequence GLEW (SEQ ID NO: 2447) at positions 44-47 according to the Kabat numbering or the amino acid sequence KERE (SEQ ID NO: 2448) or KQRE (SEQ ID NO: 2449) at positions 43-46 according to the Kabat numbering, the latter most preferably in combination with an F at position 37 and an L or an F at position 47 (as defined for the KERE-group); and can have Q or L at position 108 according to the Kabat numbering, and preferably have Q.

Also, where appropriate, Nanobodies may belong to (i.e. have characteristics of) two or more of these classes. For example, one specifically preferred group of Nanobodies has GLEW (SEQ ID NO: 2447) or a GLEW-like sequence at positions 44-47; P,R or S (and in particular R) at position 103; and Q at position 108 (which may be humanized to L).

More generally, it should be noted that the definitions referred to above describe and apply to Nanobodies in the form of a native (i.e. non-humanized) $V_{HH}$ sequence, and that humanized variants of these Nanobodies may contain other amino acid residues than those indicated above (i.e. one or more humanizing substitutions as defined herein). For example, and without limitation, in some humanized Nanobodies of the GLEW-group or the 103 P, R, S-group, Q at position 108 may be humanized to 108L. As already mentioned herein, other humanizing substitutions (and suitable combinations thereof) will become clear to the skilled person based on the disclosure herein. In addition, or alternatively, other potentially useful humanizing substitutions can be ascertained by comparing the sequence of the framework regions of a naturally occurring $V_{HH}$ sequence with the corresponding framework sequence of one or more closely related human $V_H$ sequences, after which one or more of the potentially useful humanizing substitutions (or combinations thereof) thus determined can be introduced into said $V_{HH}$ sequence (in any manner known per se, as further described herein) and the resulting humanized $V_{HH}$ sequences can be tested for affinity for the target, for stability, for ease and level of expression, and/or for other desired properties. In this way, by means of a limited degree of trial and error, other suitable humanizing substitutions (or suitable combinations thereof) can be determined by the skilled person based on the disclosure herein. Also, based on the foregoing, (the framework regions of) a Nanobody may be partially humanized or fully humanized.

Thus, in another preferred, but non-limiting aspect, a Nanobody of the invention may be a Nanobody belonging to the GLEW-group (as defined herein), and in which CDR1, CDR2 and CDR3 are as defined herein, and are preferably as defined according to one of the preferred aspects herein, and are more preferably as defined according to one of the more preferred aspects herein.

In another preferred, but non-limiting aspect, a Nanobody of the invention may be a Nanobody belonging to the KERE-group (as defined herein), and CDR1, CDR2 and CDR3 are as defined herein, and are preferably as defined according to one of the preferred aspects herein, and are more preferably as defined according to one of the more preferred aspects herein.

Thus, in another preferred, but non-limiting aspect, a Nanobody of the invention may be a Nanobody belonging to the 103 P, R, S-group (as defined herein), and in which CDR1, CDR2 and CDR3 are as defined herein, and are preferably as defined according to one of the preferred aspects herein, and are more preferably as defined according to one of the more preferred aspects herein.

Also, more generally and in addition to the 108Q, 43E/44R and 103 P,R,S residues mentioned above, the Nanobodies of the invention can contain, at one or more positions that in a conventional $V_H$ domain would form (part of) the $V_H/V_L$ interface, one or more amino acid residues that are more highly charged than the amino acid residues that naturally occur at the same position(s) in the corresponding naturally occurring $V_H$ sequence, and in particular one or more charged amino acid residues (as mentioned in Table A-2). Such substitutions include, but are not limited to, the GLEW-like sequences mentioned in Table A-3 below; as well as the substitutions that are described in the International Application WO 00/29004 for so-called "microbodies", e.g. so as to obtain a Nanobody with Q at position 108 in combination with KLEW (SEQ ID NO: 2482) at positions 44-47. Other possible substitutions at these positions will be clear to the skilled person based upon the disclosure herein.

In one aspect of the Nanobodies of the invention, the amino acid residue at position 83 is chosen from the group consisting of L, M, S, V and W; and is preferably L.

Also, in one aspect of the Nanobodies of the invention, the amino acid residue at position 83 is chosen from the group consisting of R, K, N, E, G, I, T and Q; and is most preferably either K or E (for Nanobodies corresponding to naturally occurring $V_{HH}$ domains) or R (for "humanized" Nanobodies, as described herein). The amino acid residue at position 84 is chosen from the group consisting of P, A, R, S, D T, and V in one aspect, and is most preferably P (for Nanobodies corresponding to naturally occurring $V_{HH}$ domains) or R (for "humanized" Nanobodies, as described herein).

Furthermore, in one aspect of the Nanobodies of the invention, the amino acid residue at position 104 is chosen from the group consisting of G and D; and is most preferably G.

Collectively, the amino acid residues at positions 11, 37, 44, 45, 47, 83, 84, 103, 104 and 108, which in the Nanobodies are as mentioned above, will also be referred to herein as the "Hallmark Residues". The Hallmark Residues and the amino acid residues at the corresponding positions of the most closely related human $V_H$ domain, $V_H3$, are summarized in Table A-3.

Some especially preferred but non-limiting combinations of these Hallmark Residues as occur in naturally occurring $V_{HH}$ domains are mentioned in Table A-4. For comparison, the corresponding amino acid residues of the human $V_H3$ called DP-47 have been indicated in italics.

TABLE A-3

Hallmark Residues in Nanobodies

| Position | Human $V_H3$ | Hallmark Residues |
|---|---|---|
| 11 | L, V; predominantly L | L, M, S, V, W; preferably L |
| 37 | V, I, F; usually V | $F^{(1)}$, Y, H, I, L or V, preferably $F^{(1)}$ or Y |
| 44(8) | G | $G^{(2)}$, $E^{(3)}$, A, D, Q, R, S, L; preferably $G^{(2)}$, $E^{(3)}$ or Q; most preferably $G^{(2)}$ or $E^{(3)}$. |
| 45(8) | L | $L^{(2)}$, $R^{(3)}$, C, I, L, P, Q, V; preferably $L^{(2)}$ or $R^{(3)}$ |
| 47(8) | W, Y | $W^{(2)}$, $L^{(1)}$ or $F^{(1)}$, A, G, I, M, R, S, V or Y; preferably $W^{(2)}$, $L^{(1)}$, $F^{(1)}$ or R |
| 83 | R or K; usually R | R, $K^{(5)}$, N, $E^{(5)}$, G, I, M, Q or T; preferably K or R; most preferably K |
| 84 | A, T, D; predominantly A | $P^{(5)}$, A, L, R, S, T, D, V; preferably P |
| 103 | W | $W^{(4)}$, $P^{(6)}$, $R^{(6)}$, S; preferably W |
| 104 | G | G or D; preferably G |
| 108 | L, M or T; predominantly L | Q, $L^{(7)}$ or R; preferably Q or $L^{(7)}$ |

Notes:
(1)In particular, but not exclusively, in combination with KERE (SEQ ID NO: 2448) or KQRE (SEQ ID NO: 2449) at positions 43-46.
(2)Usually as GLEW (SEQ ID NO: 2447) at positions 44-47.
(3)Usually as KERE (SEQ ID NO: 2448) or KQRE (SEQ ID NO: 2449) at positions 43-46, e.g. as KEREL (SEQ ID NO: 2450), KEREF (SEQ ID NO: 2451), KQREL (SEQ ID NO: 2452), KQREF (SEQ ID NO: 2453) or KEREG (SEQ ID NO: 2454) at positions 43-47. Alternatively, also sequences such as TERE (SEQ ID NO: 2455) (for example TEREL (SEQ ID NO: 2456)), KECE (SEQ ID NO: 2457) (for example KECEL (SEQ ID NO: 2458) or KECER (SEQ ID NO: 2459)), RERE (SEQ ID NO: 2460) (for example REREG (SEQ ID NO: 2461)), QERE (SEQ ID NO: 2462) (for example QEREG (SEQ ID NO: 2463)), KGRE (SEQ ID NO: 2464) (for example KGREG (SEQ ID NO: 2465)), KDRE (SEQ ID NO: 2466) (for example KDREV (SEQ ID NO: 2467)) are possible. Some other possible, but less preferred sequences include for example DECKL (SEQ ID NO: 2468) and NVCEL (SEQ ID NO: 2469).
(4)With both GLEW (SEQ ID NO: 2447) at positions 44-47 and KERE (SEQ ID NO: 2448) or KQRE (SEQ ID NO: 2449) at positions 43-46.
(5)Often as KP or EP at positions 83-84 of naturally occurring $V_{HH}$ domains.
(6)In particular, but not exclusively, in combination with GLEW (SEQ ID NO: 2447) at positions 44-47.
(7)With the proviso that when positions 44-47 are GLEW (SEQ ID NO: 2447), position 108 is always Q in (non-humanized) $V_{HH}$ sequences that also contain a W at 103.
(8)The GLEW group also contains GLEW-like sequences at positions 44-47, such as for example GVEW (SEQ ID NO: 2470), EPEW (SEQ ID NO: 2471), GLER (SEQ ID NO: 2472), DQEW (SEQ ID NO: 2473), DLEW (SEQ ID NO: 2474), GIEW (SEQ ID NO: 2475), ELEW (SEQ ID NO: 2476), GPEW (SEQ ID NO: 2477), EWLP (SEQ ID NO: 2478), GPER (SEQ ID NO: 2479), GLER (SEQ ID NO: 2480) and ELEW (SEQ ID NO: 2481).

In the Nanobodies, each amino acid residue at any other position than the Hallmark Residues can be any amino acid residue that naturally occurs at the corresponding position (according to the Kabat numbering) of a naturally occurring $V_{HH}$ domain.

Such amino acid residues will be clear to the skilled person. Tables A-5 to A-8 mention some non-limiting residues that can be present at each position (according to the Kabat numbering) of the FR1, FR2, FR3 and FR4 of naturally occurring $V_{HH}$ domains. For each position, the amino acid residue that most frequently occurs at each position of a naturally occurring $V_{HH}$ domain (and which is the most preferred amino acid residue for said position in a Nanobody) is indicated in bold; and other preferred amino acid residues for each position have been underlined (note: the number of amino acid residues that are found at positions 26-30 of naturally occurring $V_{HH}$ domains supports the hypothesis underlying the numbering by Chothia (supra) that the residues at these positions already form part of CDR1).

In Tables A-5-A-8, some of the non-limiting residues that can be present at each position of a human $V_H3$ domain have also been mentioned. Again, for each position, the amino acid residue that most frequently occurs at each position of a naturally occurring human $V_H3$ domain is indicated in bold; and other preferred amino acid residues have been underlined.

For reference only, Tables A-5-A-8 also contain data on the $V_{HH}$ entropy ("$V_{HH}$ Ent.") and $V_{HH}$ variability ("$V_{HH}$ Var.") at each amino acid position for a representative sample of 1118 $V_{HH}$ sequences (data kindly provided by David Lutje Hulsing and Prof. Theo Verrips of Utrecht University). The values for the $V_{HH}$ entropy and the $V_{HH}$ variability provide a measure for the variability and degree of conservation of amino acid residues between the 1118 $V_{HH}$ sequences analyzed: low values (i.e. <1, such as <0.5) indicate that an amino acid residue is highly conserved between the $V_{HH}$ sequences (i.e. little variability). For example, the G at position 8 and the G at position 9 have values for the $V_{HH}$ entropy of 0.1 and 0 respectively, indicating that these residues are highly conserved and have little variability (and in case of position 9 is G in all 1118 sequences analysed), whereas for residues that form part of the CDR's generally values of 1.5 or more are found (data not shown). Note that (1) the amino acid residues listed in the second column of Tables A-5-A-8 are based on a bigger sample than the 1118 $V_{HH}$ sequences that were analysed for determining the $V_{HH}$ entropy and $V_{HH}$ variability referred to in the last two columns; and (2) the data represented below support the hypothesis that the amino acid residues at positions 27-30 and maybe even also at positions 93

TABLE A-4

Some preferred but non-limiting combinations of Hallmark Residues in naturally occurring Nanobodies. For humanization of these combinations, reference is made to the specification.

| | 11 | 37 | 44 | 45 | 47 | 83 | 84 | 103 | 104 | 108 |
|---|---|---|---|---|---|---|---|---|---|---|
| DP-47 (human) | M | V | G | L | W | R | A | W | G | L |
| "KERE" group | L | F | E | R | L | K | P | W | G | Q |
| | L | F | E | R | F | E | P | W | G | Q |
| | L | F | E | R | F | K | P | W | G | Q |
| | L | Y | Q | R | L | K | P | W | G | Q |
| | L | F | L | R | V | K | P | Q | G | Q |
| | L | F | Q | R | L | K | P | W | G | Q |
| | L | F | E | R | F | K | P | W | G | Q |
| "GLEW" group | L | V | G | L | W | K | S | W | G | Q |
| | M | V | G | L | W | K | P | R | G | Q | and 94 already form part of the CDR's (although the invention is not limited to any specific hypothesis or explanation, and as mentioned above, herein the numbering according to Kabat is used). For a general explanation of sequence entropy, sequence variability and the methodology for determining the same, see Oliveira et al., PROTEINS: Structure, Function and Genetics, 52: 544-552 (2003).

TABLE A-5

Non-limiting examples of amino acid residues in FR1
(for the footnotes, see the footnotes to Table A-3)

| | Amino acid residue(s): | | $V_{HH}$ | $V_{HH}$ |
|---|---|---|---|---|
| Pos. | Human $V_H3$ | Camelid $V_{HH}$'s | Ent. | Var. |
| 1 | E, Q | Q, A, E | — | — |
| 2 | V | V | 0.2 | 1 |
| 3 | Q | Q, K | 0.3 | 2 |
| 4 | L | L | 0.1 | 1 |
| 5 | V, L | Q, E, L, V | 0.8 | 3 |
| 6 | E | E, D, Q, A | 0.8 | 4 |
| 7 | S, T | S, F | 0.3 | 2 |
| 8 | G, R | G | 0.1 | 1 |
| 9 | G | G | 0 | 1 |
| 10 | G, V | G, D, R | 0.3 | 2 |
| 11 | | Hallmark residue: L, M, S, V, W; preferably L | 0.8 | 2 |
| 12 | V, I | V, A | 0.2 | 2 |
| 13 | Q, K, R | Q, E, K, P, R | 0.4 | 4 |
| 14 | P | A, Q, A, G, P, S, T, V | 1 | 5 |
| 15 | G | G | 0 | 1 |
| 16 | G, R | G, A, E, D | 0.4 | 3 |
| 17 | S | S, F | 0.5 | 2 |
| 18 | L | L, V | 0.1 | 1 |
| 19 | R, K | R, K, L, N, S, T | 0.6 | 4 |
| 20 | L | L, F, I, V | 0.5 | 4 |
| 21 | S | S, A, F, T | 0.2 | 3 |
| 22 | C | C | 0 | 1 |
| 23 | A, T | A, D, E, P, S, T, V | 1.3 | 5 |
| 24 | A | A, I, L, S, T, V | 1 | 6 |
| 25 | S | S, A, F, P, T | 0.5 | 5 |
| 26 | G | G, A, D, E, R, S, T, V | 0.7 | 7 |
| 27 | F | S, F, R, L, P, G, N, | 2.3 | 13 |
| 28 | T | N, T, E, D, S, I, R, A, G, R, F, Y | 1.7 | 11 |
| 29 | F, V | F, L, D, S, I, G, V, A | 1.9 | 11 |
| 30 | S, D, G | N, S, E, G, A, D, M, T | 1.8 | 11 |

TABLE A-6

Non-limiting examples of amino acid residues in FR2
(for the footnotes, see the footnotes to Table A-3)

| | Amino acid residue(s): | | $V_{HH}$ | $V_{HH}$ |
|---|---|---|---|---|
| Pos. | Human $V_H3$ | Camelid $V_{HH}$'s | Ent. | Var. |
| 36 | W | W | 0.1 | 1 |
| 37 | | Hallmark residue: F[1], H, I, L, Y or V, preferably F[1] or Y | 1.1 | 6 |
| 38 | R | R | 0.2 | 1 |
| 39 | Q | Q, H, P, R | 0.3 | 2 |
| 40 | A | A, F, G, L, P, T, V | 0.9 | 7 |
| 41 | P, S, T | P, A, L, S | 0.4 | 3 |
| 42 | G | G, E | 0.2 | 2 |
| 43 | K | K, D, E, N, Q, R, T, V | 0.7 | 6 |
| 44 | | Hallmark residue: G[2], E[3], A, D, Q, R, S, L; preferably G[2], E[3] or Q; most preferably G[2] or E[3]. | 1.3 | 5 |
| 45 | | Hallmark residue: L[2], R[3], C, I, L, P, Q, V; preferably L[2] or R[3] | 0.6 | 4 |
| 46 | E, V | E, D, K, Q, V | 0.4 | 2 |
| 47 | | Hallmark residue: W[2], L[1] or F[1], A, G, I, M, R, S, V or Y; preferably W[2], L[1], F[1] or R | 1.9 | 9 |
| 48 | V | V, I, L | 0.4 | 3 |
| 49 | S, A, G | A, S, G, T, V | 0.8 | 3 |

TABLE A-7

Non-limiting examples of amino acid residues in FR3
(for the footnotes, see the footnotes to Table A-3)

| | Amino acid residue(s): | | $V_{HH}$ | $V_{HH}$ |
|---|---|---|---|---|
| Pos. | Human $V_H3$ | Camelid $V_{HH}$'s | Ent. | Var. |
| 66 | R | R | 0.1 | 1 |
| 67 | F | F, L, V | 0.1 | 1 |
| 68 | T | T, A, N, S | 0.5 | 4 |
| 69 | I | I, L, M, V | 0.4 | 4 |
| 70 | S | S, A, F, T | 0.3 | 4 |
| 71 | R | R, G, H, I, L, K, Q, S, T, W | 1.2 | 8 |
| 72 | D, E | D, E, G, N, V | 0.5 | 4 |
| 73 | N, D, G | N, A, D, F, I, K, L, R, S, T, V, Y | 1.2 | 9 |
| 74 | A, S | A, D, G, N, P, S, T, V | 1 | 7 |
| 75 | K | K, A, E, K, L, N, Q, R | 0.9 | 6 |
| 76 | N, S | N, D, K, R, S, T, Y | 0.9 | 6 |
| 77 | S, T, I | T, A, E, I, M, P, S | 0.8 | 5 |
| 78 | L, A | V, L, A, F, G, I, M | 1.2 | 5 |
| 79 | Y, H | Y, A, D, F, H, N, S, T | 1 | 7 |
| 80 | L | L, F, V | 0.1 | 1 |
| 81 | Q | Q, E, I, L, R, T | 0.6 | 5 |
| 82 | M | M, I, L, V | 0.2 | 2 |
| 82a | N, G | N, D, G, H, S, T | 0.8 | 4 |
| 82b | S | S, N, D, G, R, T | 1 | 6 |
| 82c | L | L, P, V | 0.1 | 2 |
| 83 | | Hallmark residue: R, K[5], N, E[5], G, I, M, Q or T; preferably K or R; most preferably K | 0.9 | 7 |
| 84 | | Hallmark residue: P[5], A, D, L, R, S, T, V; preferably P | 0.7 | 6 |
| 85 | E, G | E, D, G, Q | 0.5 | 3 |
| 86 | D | D | 0 | 1 |
| 87 | T, M | T, A, S | 0.2 | 3 |
| 88 | A | A, G, S | 0.3 | 2 |
| 89 | V, L | V, A, D, I, L, M, N, R, T | 1.4 | 6 |
| 90 | Y | Y, F | 0 | 1 |
| 91 | Y, H | Y, D, F, H, L, S, T, V | 0.6 | 4 |
| 92 | C | C | 0 | 1 |
| 93 | A, K, T | A, N, G, H, K, N, R, S, T, V, Y | 1.4 | 10 |
| 94 | K, R, T | A, V, C, F, G, I, K, L, R, S or T | 1.6 | 9 |

TABLE A-8

Non-limiting examples of amino acid residues in FR4
(for the footnotes, see the footnotes to Table A-3)

| | Amino acid residue(s): | | $V_{HH}$ | $V_{HH}$ |
|---|---|---|---|---|
| Pos. | Human $V_H3$ | Camelid $V_{HH}$'s | Ent. | Var. |
| 103 | | Hallmark residue: W[4], P[6], R[6], S; preferably W | 0.4 | 2 |
| 104 | | Hallmark residue: G or D; preferably G | 0.1 | 1 |
| 105 | Q, R | Q, E, K, P, R | 0.6 | 4 |
| 106 | G | G | 0.1 | 1 |
| 107 | T | T, A, I | 0.3 | 2 |
| 108 | | Hallmark residue: Q, L[7] or R; preferably Q or L[7] | 0.4 | 3 |
| 109 | V | V | 0.1 | 1 |
| 110 | T | T, I, A | 0.2 | 1 |
| 111 | V | V, A, I | 0.3 | 2 |
| 112 | S | S, F | 0.3 | 1 |
| 113 | S | S, A, L, P, T | 0.4 | 3 |

Thus, in another preferred, but not limiting aspect, a Nanobody of the invention can be defined as an amino acid sequence with the (general) structure

FR1-CDR1-FR2-CDR2-FR3-CDR3-FR4 in which FR1 to FR4 refer to framework regions 1 to 4, respectively, and in which CDR1 to CDR3 refer to the complementarity determining regions 1 to 3, respectively, and in which:

i) one or more of the amino acid residues at positions 11, 37, 44, 45, 47, 83, 84, 103, 104 and 108 according to the Kabat numbering are chosen from the Hallmark residues mentioned in Table A-3;
and in which:
ii) CDR1, CDR2 and CDR3 are as defined herein, and are preferably as defined according to one of the preferred aspects herein, and are more preferably as defined according to one of the more preferred aspects herein.

The above Nanobodies may for example be $V_{HH}$ sequences or may be humanized Nanobodies. When the above Nanobody sequences are $V_{HH}$ sequences, they may be suitably humanized, as further described herein. When the Nanobodies are partially humanized Nanobodies, they may optionally be further suitably humanized, again as described herein.

In particular, a Nanobody of the invention can be an amino acid sequence with the (general) structure

FR1-CDR1-FR2-CDR2-FR3-CDR3-FR4 in which FR1 to FR4 refer to framework regions 1 to 4, respectively, and in which. CDR1 to CDR3 refer to the complementarity determining regions 1 to 3, respectively, and in which:
i) (preferably) one or more of the amino acid residues at positions 11, 37, 44, 45, 47, 83, 84, 103, 104 and 108 according to the Kabat numbering are chosen from the Hallmark residues mentioned in Table A-3 (it being understood that $V_{HH}$ sequences will contain one or more Hallmark residues; and that partially humanized Nanobodies will usually, and preferably, [still] contain one or more Hallmark residues [although it is also within the scope of the invention to provide—where suitable in accordance with the invention—partially humanized Nanobodies in which all Hallmark residues, but not one or more of the other amino acid residues, have been humanized]; and that in fully humanized Nanobodies, where suitable in accordance with the invention, all amino acid residues at the positions of the Hallmark residues will be amino acid residues that occur in a human $V_H3$ sequence. As will be clear to the skilled person based on the disclosure herein that such $V_{HH}$ sequences, such partially humanized Nanobodies with at least one Hallmark residue, such partially humanized Nanobodies without Hallmark residues and such fully humanized Nanobodies all form aspects of this invention);
and in which:
ii) said amino acid sequence has at least 80% amino acid identity with at least one of the amino acid sequences of SEQ ID NO's: 1 to 22, in which for the purposes of determining the degree of amino acid identity, the amino acid residues that form the CDR sequences (indicated with X in the sequences of SEQ ID NO's: 1 to 22) are disregarded;
and in which:
iii) CDR1, CDR2 and CDR3 are as defined herein, and are preferably as defined according to one of the preferred aspects herein, and are more preferably as defined according to one of the more preferred aspects herein.

The above Nanobodies may for example be $V_{HH}$ sequences or may be humanized Nanobodies. When the above Nanobody sequences are $V_{HH}$ sequences, they may be suitably humanized, as further described herein. When the Nanobodies are partially humanized Nanobodies, they may optionally be further suitably humanized, again as described herein.

TABLE A-9

Representative amino acid sequences for Nanobodies of the KERE, GLEW and P, R, S 1.03 group. The CDR's are indicated with XXXX

| | | |
|---|---|---|
| KERE sequence no. 1 | SEQ ID NO: 1 | EVQLVESGGGLVQPGGSLRLSCAASGIPFSXXXXXWFRQAPGKQRDSVAXXXXXXRFTISRDNA KNTVYLQMNSLKPEDTAVYRCYFXXXXXXWGQGTQVTVSS |
| KERE sequence no. 2 | SEQ ID NO: 2 | QVKLEESGGGLVQAGGSLRLSCVGSGRTESXXXXXWFRLAPGKEREFVAXXXXXXRFTISRDTA SNRGYLHMNNLTPEDTAVYYCAAXXXXXXWGQGTQVTVSS |
| KERE sequence no. 3 | SEQ ID NO: 3 | AVQLVDSGGGLVQAGDSLKLSCALTGGAFTXXXXXWERQTPGREREFVAXXXXXXRFTI SRDNAKNMVYLRMNSLIPEDAAVYSCAAXXXXXXWGQGTLVTVSS |
| KERE sequence no. 4 | SEQ ID NO: 4 | QVQLVESGGGLVEAGGSLRLSCTASESPFRXXXXXWFRQTSGQEREFVAXXXXXXRFTI SRDDAKNTVWLHGSTLKPEDTAVYYCAAXXXXXXWGQGTQVTVSS |
| KERE sequence no. 5 | SEQ ID NO: 5 | AVQLVESGGGLVQGGGSLRLACAASERIFDXXXXXWYRQGPGNERELVAXXXXXXRFTI SMDYTKQTVYLHMNSLRPEDTGLYYCKIXXXXXXWGQGTQVTVSS |
| KERE sequence no. 6 | SEQ ID NO: 6 | DVKFVESGGGLVQAGGSLRLSCVASGFNFDXXXXXWFRQAPGKEREEVAXXXXXXRFT ISSEKDKNSVYLQMNSLKPEDTALYICAGXXXXXXWGRGTQVTVSS |
| KERE sequence no. 7 | SEQ ID NO: 7 | QVRLAESGGGLVQSGGSLRLSCVASGSTYTXXXXXWYRQYPGKQRALVAXXXXXXRFT IARDSTKDTFCLQMNNLKPEDTAVYYCYAXXXXXXWGQGTQVTVSS |
| KERE sequence no. 8 | SEQ ID NO: 8 | EVQLVESGGGLVQAGGSLRLSCAASGFTSDXXXXXWFRQAPGKPREGVSXXXXXXRFT ISTDNAKNTVHLLMNRVNAEDTALYYCAVXXXXXXWGRGTRVTVSS |
| KERE sequence no. 9 | SEQ ID NO: 9 | QVQLVESGGGLVQPGGSLRLSCQASGDISTXXXXXWYRQVPGKLREFVAXXXXXXRFTI SGDNAKRAIYLQMNNLKPDDTAVYYCNRXXXXXXWGQGTQVTVSP |
| KERE sequence no. 10 | SEQ ID NO: 10 | QVPVVESGGGLVQAGDSLRLFCAVPSFTSTXXXXXWFRQAPGKEREFVAXXXXXXRFTI SRNATKNTLTLRMDSLKPEDTAVYYCAAXXXXXXWGQGTQVTVSS |
| KERE sequence no. 11 | SEQ ID NO: 11 | EVQLVESGGGLVQAGDSLRLFCTVSGGTASXXXXXWFRQAPGEKREFVAXXXXXXRFTI ARENAGNMVYLQMNNLKPDDTALYTCAAXXXXXXWGRGTQVTVSS |
| KERE sequence no. 12 | SEQ ID NO: 12 | AVQLVESGGDSVQPGDSQTLSCAASGRTNSXXXXXWFRQAPGKERVFLAXXXXXXRFT ISRDSAKNMMYLQMNNLKPQDTAVYYCAAXXXXXXWGQGTQVTVSS |

TABLE A-9-continued

Representative amino acid sequences for Nanobodies of the KERE, GLEW and P, R, S 1.03 group. The CDR's are indicated with XXXX

| | | |
|---|---|---|
| KERE sequence no. 13 | SEQ ID NO: 13 | AVQLVESGGGLVQAGGSLRLSCVVSGLTSSXXXXXXWFRQTPWQERDFVAXXXXXXRFT ISRDNYKDTVLLEMNFLKPEDTAIYYCAAXXXXXXWGQGTQVTVSS |
| KERE sequence no. 14 | SEQ ID NO: 14 | AVQLVESGGGLVQAGASLRLSCATSTRTLDXXXXXXWFRQAPGRDREFVAXXXXXXRFT VSRDSAENTVALQMNSLKPEDTAVYYCAAXXXXXXWGQGTRVTVSS |
| KERE sequence no. 15 | SEQ ID NO: 15 | QVQLVESGGGLVQPGGSLRLSCTVSRLTAHXXXXXXWFRQAPGKEREAVSXXXXXXRFTI SRDYAGNTAFLQMDSLKPEDTGVYYCATXXXXXWGQGTQVTVSS |
| KERE sequence no. 16 | SEQ ID NO: 16 | EVQLVESGGELVQAGGSLKLSCTASGRNFVXXXXXXWFRRAPGKEREFVAXXXXXXRFT VSRDNGKNTAYLRMNSLKPEDTADYYCAVXXXXXLGSGTQVTVSS |
| GLEW sequence no. 1 | SEQ ID NO: 17 | AVQLVESGGGLVQPGGSLRLSCAASGFTFSXXXXXXWVRQAPGKVLEWVSXXXXXXRFT SRDNAKNTLYLQMNSLKPEDTAVYYCVKXXXXXGSQGTQVTVSS |
| GLEW sequence no. 2 | SEQ ID NO: 18 | EVQLVESGGGLVQPGGSLRLSCVCVSSGCTXXXXXXWVRQAPGKAEEWVSXXXXXXRF KISRDNAKKTLYLQMNSLGPEDTAMYYCQRXXXXXXRGQGTQVTVSS |
| GLEW sequence no. 3 | SEQ ID NO: 19 | EVQLVESGGGLALPGGSLTLSCVFSGSTFSXXXXXXWVRHTPGKAEEWVSXXXXXXRFTI SRDNAKNTLYLEMNSLPEDTAMYYCGRXXXXXXRSKGIQVTVSS |
| P, R, S 103 sequence no. 1 | SEQ ID NO: 20 | AVQLVESGGGLVQAGGSLRLSCAASGRTFSXXXXXXWFRQAPGKEREFVAXXXXXXRFTI SRDNAKNTVYLQMNSLKPEDTAVYYCAAXXXXXXRGQGTQVTVSS |
| P, R, S 103 sequence no. 2 | SEQ ID NO: 21 | DVQLVESGGDLVQPGGSLRLSCAASGFSFDXXXXXXWLRQTPGKGLEWVGXXXXXXRFT ISRDNAKNMLYLHLNNLKSEDTAVYYCRRXXXXXLGQGTQVTVSS |
| P, R, S 103 sequence no. 3 | SEQ ID NO: 22 | EVQLVESGGGLVQPGGSLRLSCVCVSSGCTXXXXXXWVRQAPGKAEEWVSXXXXXXRF KISRDNAKKTLYLQMNSLGPEDTAMYYCQRXXXXXXRGQGTQVTVSS |

In particular, a Nanobody of the invention of the KERE group can be an amino acid sequence with the (general) structure

FR1-CDR1-FR2-CDR2-FR3-CDR3-FR4 in which:

i) the amino acid residue at position 45 according to the Kabat numbering is a charged amino acid (as defined herein) or a cysteine residue, and position 44 is preferably an E;

and in which:

ii) FR1 is an amino acid sequence that has at least 80% amino acid identity with at least one of the following amino acid sequences:

and in which:

iii) FR2 is an amino acid sequence that has at least 80% amino acid identity with at least one of the following amino acid sequences:

TABLE A-11

Representative FW2 sequences for Nanobodies of the KERE-group.

| | | |
|---|---|---|
| KERE FW2 sequence no. 1 | SEQ ID NO: 41 | WFRQAPGKEREFVA |

TABLE A-10

Representative FW1 sequences for Nanobodies of the KERE-group.

| | | |
|---|---|---|
| KERE FW1 sequence no. 1 | SEQ ID NO: 23 | QVQRVESGGGLVQAGGSLRLSCAASGRTSS |
| KERE FW1 sequence no. 2 | SEQ ID NO: 24 | QVQLVESGGGLVQTGDSLSLSCSASGRTFS |
| KERE FW1 sequence no. 3 | SEQ ID NO: 25 | QVKLEESGGGLVQAGDSLRLSCAATGRAFG |
| KERE FW1 sequence no. 4 | SEQ ID NO: 26 | AVQLVESGGGLVQPGESLGLSCVASGRDFV |
| KERE FW1 sequence no. 5 | SEQ ID NO: 27 | EVQLVESGGGLVQAGGSLRLSCEVLGRTAG |
| KERE FW1 sequence no. 6 | SEQ ID NO: 28 | QVQLVESGGGWVQPGGSLRLSCAASETILS |
| KERE FW1 sequence no. 7 | SEQ ID NO: 29 | QVQLVESGGGTVQPGGSLNLSCVASGNTFN |
| KERE FW1 sequence no. 8 | SEQ ID NO: 30 | EVQLVESGGGLAQPGGSLQLSCSAPGFTLD |
| KERE FW1 sequence no. 9 | SEQ ID NO: 31 | AQELEESGGGLVQAGGSLRLSCAASGRTFN |

TABLE A-11-continued

Representative FW2 sequences for Nanobodies of the KERE-group.

| | | |
|---|---|---|
| KERE FW2 sequence no. 2 | SEQ ID NO: 42 | WFRQTPGREREFVA |
| KERE FW2 sequence no. 3 | SEQ ID NO: 43 | WYRQAPGKQREMVA |
| KERE FW2 sequence no. 4 | SEQ ID NO: 44 | WYRQGPGKQRELVA |
| KERE FW2 sequence no. 5 | SEQ ID NO: 45 | WIRQAPGKEREGVS |
| KERE FW2 sequence no. 6 | SEQ ID NO: 46 | WFREAPGKEREGIS |
| KERE FW2 sequence no. 7 | SEQ ID NO: 47 | WYRQAPGKERDLVA |
| KERE FW2 sequence no. 8 | SEQ ID NO: 48 | WFRQAPGKQREEVS |
| KERE FW2 sequence no. 9 | SEQ ID NO: 49 | WFRQPPGKVREFVG | and in which:

iv) FR3 is an amino acid sequence that has at least 80% amino acid identity with at least one of the following amino acid sequences:

TABLE A-12

Representative FW3 sequences for Nanobodies of the KERE-group.

| | | |
|---|---|---|
| KERE FW3 sequence no. 1 | SEQ ID NO: 50 | RFTISRDNAKNTVYLQMNSL KPEDTAVYRCYF |
| KERE FW3 sequence no. 2 | SEQ ID NO: 51 | RFAISRDNNKNTGYLQMNSL EPEDTAVYYCAA |
| KERE FW3 sequence no. 3 | SEQ ID NO: 52 | RFTVARNNAKNTVNLEMNSL KPEDTAVYYCAA |
| KERE FW3 sequence no. 4 | SEQ ID NO: 53 | RFTISRDIAKNTVDLLMNNL EPEDTAVYYCAA |
| KERE FW3 sequence no. 5 | SEQ ID NO: 54 | RLTISRDNAVDTMYLQMNSL KPEDTAVYYCAA |
| KERE FW3 sequence no. 6 | SEQ ID NO: 55 | RFTISRDNAKNTVYLQMDNV KPEDTAIYYCAA |
| KERE FW3 sequence no. 7 | SEQ ID NO: 56 | RFTISKDSGKNTVYLQMTSL KPEDTAVYYCAT |
| KERE FW3 sequence no. 8 | SEQ ID NO: 57 | RFTISRDSAKNMMYLQMNNL KPQDTAVYYCAA |
| KERE FW3 sequence no. 9 | SEQ ID NO: 58 | RFTISRENDKSTVYLQLNSL KPEDTAVYYCAA |
| KERE FW3 sequence no. 10 | SEQ ID NO: 59 | RFTISRDYAGNTAYLQMNSL KPEDTGVYYCAT | and in which:

v) FR4 is an amino acid sequence that has at least 80% amino acid identity with at least one of the following amino acid sequences:

TABLE A-13

Representative FW4 sequences for Nanobodies of the KERE-group.

| | | |
|---|---|---|
| KERE FW4 sequence no. 1 | SEQ ID NO: 60 | WGQGTQVTVSS |
| KERE FW4 sequence no. 2 | SEQ ID NO: 61 | WGKGTLVTVSS |
| KERE FW4 sequence no. 3 | SEQ ID NO: 62 | RGQGTRVTVSS |
| KERE FW4 sequence no. 4 | SEQ ID NO: 63 | WGLGTQVTISS | and in which:

vi) CDR1, CDR2 and CDR3 are as defined herein, and are preferably as defined according to one of the preferred aspects herein, and are more preferably as defined according to one of the more preferred aspects herein.

In the above Nanobodies, one or more of the further Hallmark residues are preferably as described herein (for example, when they are $V_{HH}$ sequences or partially humanized Nanobodies).

Also, the above Nanobodies may for example be $V_{HH}$ sequences or may be humanized Nanobodies. When the above Nanobody sequences are $V_{HH}$ sequences, they may be suitably humanized, as further described herein. When the Nanobodies are partially humanized Nanobodies, they may optionally be further suitably humanized, again as described herein.

With regard to framework 1, it will be clear to the skilled person that, when an amino acid sequence as outlined above is generated by expression of a nucleotide sequence, the first four amino acid sequences (i.e. amino acid residues 1-4 according to the Kabat numbering) may often be determined by the primer(s) that have been used to generate said nucleic acid. Thus, for determining the degree of amino acid identity, the first four amino acid residues are preferably disregarded.

Also, with regard to framework 1, and although amino acid positions 27 to 30 are according to the Kabat numbering considered to be part of the framework regions (and not the CDR's), it has been found by analysis of a database of more than 1000 $V_{HH}$ sequences that the positions 27 to 30 have a variability (expressed in terms of $V_{HH}$ entropy and $V_{HH}$ variability—see Tables A-5 to A-8) that is much greater than the variability on positions 1 to 26. Because of this, for determining the degree of amino acid identity, the amino acid residues at positions 27 to 30 are preferably also disregarded.

In view of this, a Nanobody of the KERE class may be an amino acid sequence that is comprised of four framework regions/sequences interrupted by three complementarity determining regions/sequences, in which:

i) the amino acid residue at position 45 according to the Kabat numbering is a charged amino acid (as defined herein) or a cysteine residue, and position 44 is preferably an E; and in which:

ii) FR1 is an amino acid sequence that, on positions 5 to 26 of the Kabat numbering, has at least 80% amino acid identity with at least one of the following amino acid sequences:

TABLE A-14

Representative FW1 sequences (amino acid residues 5 to 26) for Nanobodies of the KERE-group.

| | | |
|---|---|---|
| KERE FW1 sequence no. 10 | SEQ ID NO: 32 | VESGGGLVQPGGSLRLSCAASG |

TABLE A-14-continued

Representative FW1 sequences
(amino acid residues 5 to 26) for
Nanobodies of the KERE-group.

| | | |
|---|---|---|
| KERE FW1 sequence no. 11 | SEQ ID NO: 33 | VDSGGGLVQAGDSLKLSCALTG |
| KERE FW1 sequence no. 12 | SEQ ID NO: 34 | VDSGGGLVQAGDSLRLSCAASG |
| KERE FW1 sequence no. 13 | SEQ ID NO: 35 | VDSGGGLVEAGGSLRLSCQVSE |
| KERE FW1 sequence no. 14 | SEQ ID NO: 36 | QDSGGGSVQAGGSLKLSCAASG |
| KERE FW1 sequence no. 15 | SEQ ID NO: 37 | VQSGGRLVQAGDSLRLSCAASE |
| KERE FW1 sequence no. 16 | SEQ ID NO: 38 | VESGGTLVQSGDSLKLSCASST |
| KERE FW1 sequence no. 17 | SEQ ID NO: 39 | MESGGDSVQSGGSLTLSCVASG |
| KERE FW1 sequence no. 18 | SEQ ID NO: 40 | QASGGGLVQAGGSLRLSCSASV | and in which:
iii) FR2, FR3 and FR4 are as mentioned herein for FR2, FR3 and FR4 of Nanobodies of the KERE-class;
and in which:
iv) CDR1, CDR2 and CDR3 are as defined herein, and are preferably as defined according to one of the preferred aspects herein, and are more preferably as defined according to one of the more preferred aspects herein.

The above Nanobodies may for example be V$_{HH}$ sequences or may be humanized Nanobodies. When the above Nanobody sequences are V$_{HH}$ sequences, they may be suitably humanized, as further described herein. When the Nanobodies are partially humanized Nanobodies, they may optionally be further suitably humanized, again as described herein.

A Nanobody of the GLEW class may be an amino acid sequence that is comprised of four framework regions/sequences interrupted by three complementarity determining regions/sequences, in which
i) preferably, when the Nanobody of the GLEW-class is a non-humanized Nanobody, the amino acid residue in position 108 is Q;
ii) FR1 is an amino acid sequence that has at least 80% amino acid identity with at least one of the following amino acid sequences:

TABLE A-15

Representative FW1 sequences for Nanobodies of the GLEW-group.

| | | |
|---|---|---|
| GLEW FW1 sequence no. 1 | SEQ ID NO: 64 | QVQLVESGGGLVQPGGSLRL SCAASGFTFS |
| GLEW FW1 sequence no. 2 | SEQ ID NO: 65 | EVHLVESGGGLVRPGGSLRL SCAAFGFIFK |
| GLEW FW1 sequence no. 3 | SEQ ID NO: 66 | QVKLEESGGGLAQPGGSLRL SCVASGFTFS |
| GLEW FW1 sequence no. 4 | SEQ ID NO: 67 | EVQLVESGGGLVQPGGSLRL SCVCVSSGCT |
| GLEW FW1 sequence no. 5 | SEQ ID NO: 68 | EVQLVESGGGLALPGGSLTL SCVFSGSTFS | and in which:
iii) FR2 is an amino acid sequence that has at least 80% amino acid identity with at least one of the following amino acid sequences:

TABLE A-16

Representative FW2 sequences for Nanobodies of the GLEW-group.

| | | |
|---|---|---|
| GLEW FW2 sequence no. 1 | SEQ ID NO: 72 | WVRQAPGKVLEWVS |
| GLEW FW2 sequence no. 2 | SEQ ID NO: 73 | WVRRPPGKGLEWVS |
| GLEW FW2 sequence no. 3 | SEQ ID NO: 74 | WVRQAPGMGLEWVS |
| GLEW FW2 sequence no. 4 | SEQ ID NO: 75 | WVRQAPGKEPEWVS |
| GLEW FW2 sequence no. 5 | SEQ ID NO: 76 | WVRQAPGKDQEWVS |
| GLEW FW2 sequence no. 6 | SEQ ID NO: 77 | WVRQAPGKAEEWVS |
| GLEW FW2 sequence no. 7 | SEQ ID NO: 78 | WVRQAPGKGLEWVA |
| GLEW FW2 sequence no. 8 | SEQ ID NO: 79 | WVRQAPGRATEWVS | and in which:
iv) FR3 is an amino acid sequence that has at least 80% amino acid identity with at least one of the following amino acid sequences:

TABLE A-17

Representative FW3 sequences for Nanobodies of the GLEW-group.

| | | |
|---|---|---|
| GLEW FW3 sequence no. 1 | SEQ ID NO: 80 | RFTISRDNAKNTLYLQMNSLK PEDTAVYYCVK |
| GLEW FW3 sequence no. 2 | SEQ ID NO: 81 | RFTISRDNARNTLYLQMDSLIP EDTALYYCAR |
| GLEW FW3 sequence no. 3 | SEQ ID NO: 82 | RFTSSRDNAKSTLYLQMNDLK PEDTALYYCAR |
| GLEW FW3 sequence no. 4 | SEQ ID NO: 83 | RFIISRDNAKNTLYLQMNSLGP EDTAMYYCQR |
| GLEW FW3 sequence no. 5 | SEQ ID NO: 84 | RFTASRDNAKNTLYLQMNSLKS EDTARYYCAR |
| GLEW FW3 sequence no. 6 | SEQ ID NO: 85 | RFTISRDNAKNTLYLQMDDLQS EDTAMYYCGR | and in which:
v) FR4 is an amino acid sequence that has at least 80% amino acid identity with at least one of the following amino acid sequences:

TABLE A-18

Representative FW4 sequences for Nanobodies of the GLEW-group.

| | | |
|---|---|---|
| GLEW FW4 sequence no. 1 | SEQ ID NO: 86 | GSQGTQVTVSS |
| GLEW FW4 sequence no. 2 | SEQ ID NO: 87 | LRGGTQVTVSS |
| GLEW FW4 sequence no. 3 | SEQ ID NO: 88 | RGQGTLVTVSS |
| GLEW FW4 sequence no. 4 | SEQ ID NO: 89 | RSRGIQVTVSS |
| GLEW FW4 sequence no. 5 | SEQ ID NO: 90 | WGKGTQVTVSS |
| GLEW FW4 sequence no. 6 | SEQ ID NO: 91 | WGQGTQVTVSS | and in which:
vi) CDR1, CDR2 and CDR3 are as defined herein, and are preferably as defined according to one of the preferred aspects herein, and are more preferably as defined according to one of the more preferred aspects herein.

In the above Nanobodies, one or more of the further Hallmark residues are preferably as described herein (for example, when they are $V_{HH}$ sequences or partially humanized Nanobodies).

With regard to framework 1, it will again be clear to the skilled person that, for determining the degree of amino acid identity, the amino acid residues on positions 1 to 4 and 27 to 30 are preferably disregarded.

In view of this, a Nanobody of the GLEW class may be an amino acid sequence that is comprised of four framework regions/sequences interrupted by three complementarity determining regions/sequences, in which:
i) preferably, when the Nanobody of the GLEW-class is a non-humanized Nanobody, the amino acid residue in position 108 is Q;
and in which:
ii) FR1 is an amino acid sequence that, on positions 5 to 26 of the Kabat numbering, has at least 80% amino acid identity with at least one of the following amino acid sequences:

TABLE A-19

Representative FW1 sequences (amino acid residues 5 to 26) for Nanobodies of the KERE-group.

| | | |
|---|---|---|
| GLEW FW1 sequence no. 6 | SEQ ID NO: 69 | VESGGGLVQPGGSLRLSCAASG |
| GLEW FW1 sequence no. 7 | SEQ ID NO: 70 | EESGGGLAQPGGSLRLSCVASG |
| GLEW FW1 sequence no. 8 | SEQ ID NO: 71 | VESGGGLALPGGSLTLSCVFSG | and in which:
iii) FR2, FR3 and FR4 are as mentioned herein for FR2, FR3 and FR4 of Nanobodies of the GLEW-class;
and in which:
iv) CDR1, CDR2 and CDR3 are as defined herein, and are preferably as defined according to one of the preferred aspects herein, and are more preferably as defined according to one of the more preferred aspects herein.

The above Nanobodies may for example be $V_{HH}$ sequences or may be humanized Nanobodies. When the above Nanobody sequences are $V_{HH}$ sequences, they may be suitably humanized, as further described herein. When the Nanobodies are partially humanized Nanobodies, they may optionally be further suitably humanized, again as described herein. In the above Nanobodies, one or more of the further Hallmark residues are preferably as described herein (for example, when they are $V_{HH}$ sequences or partially humanized Nanobodies).

A Nanobody of the P, R, S 103 class may be an amino acid sequence that is comprised of four framework regions/sequences interrupted by three complementarity determining regions/sequences, in which
i) the amino acid residue at position 103 according to the Kabat numbering is different from W;
and in which:
ii) preferably the amino acid residue at position 103 according to the Kabat numbering is P, R or S, and more preferably R;
and in which:
iii) FR1 is an amino acid sequence that has at least 80% amino acid identity with at least one of the following amino acid sequences:

TABLE A-20

Representative FW1 sequences for Nanobodies of the P, R, S 103-group.

| | | |
|---|---|---|
| P, R, S 103 FW1 sequence no. 1 | SEQ ID NO: 92 | AVQLVESGGGLVQAGGSLRLSCAASGRTFS |
| P, R, S 103 FW1 sequence no. 2 | SEQ ID NO: 93 | QVQLQESGGGMVQPGGSLRLSCAASGFDFG |
| P, R, S 103 FW1 sequence no. 3 | SEQ ID NO: 94 | EVHLVESGGGLVRPGGSLRLSCAAFGFIFK |
| P, R, S 103 FW1 sequence no. 4 | SEQ ID NO: 95 | QVQLAESGGGLVQPGGSLKLSCAASRTIVS |
| P, R, S 103 FW1 sequence no. 5 | SEQ ID NO: 96 | QEHLVESGGGLVDIGGSLRLSCAASERIFS |
| P, R, S 103 FW1 sequence no. 6 | SEQ ID NO: 97 | QVKLEESGGGLAQPGGSLRLSCVASGFTFS |
| P, R, S 103 FW1 sequence no. 7 | SEQ ID NO: 98 | EVQLVESGGGLVQPGGSLRLSCVCVSSGCT |
| P, R, S 103 FW1 sequence no. 8 | SEQ ID NO: 99 | EVQLVESGGGLALPGGSLTLSCVFSGSTFS | and in which
iv) FR2 is an amino acid sequence that has at least 80% amino acid identity with at least one of the following amino acid sequences:

TABLE A-21

Representative FW2 sequences for Nanobodies of the P, R, S 103-group.

| | | |
|---|---|---|
| P, R, S 103 FW2 sequence no. 1 | SEQ ID NO: 102 | WFRQAPGKEREFVA |
| P, R, S 103 FW2 sequence no. 2 | SEQ ID NO: 103 | WVRQAPGKVLEWVS |
| P, R, S 103 FW2 sequence no. 3 | SEQ ID NO: 104 | WVRRPPGKGLEWVS |
| P, R, S 103 FW2 sequence no. 4 | SEQ ID NO: 105 | WIRQAPGKEREGVS |

TABLE A-21-continued

Representative FW2 sequences for Nanobodies of the P, R, S 103-group.

| | | |
|---|---|---|
| P, R, S 103 FW2 sequence no. 5 | SEQ ID NO: 106 | WVRQYPGKEPEWVS |
| P, R, S 103 FW2 sequence no. 6 | SEQ ID NO: 107 | WFRQPPGKEHEFVA |
| P, R, S 103 FW2 sequence no. 7 | SEQ ID NO: 108 | WYRQAPGKRTELVA |
| P, R, S 103 FW2 sequence no. 8 | SEQ ID NO: 109 | WLRQAPGQGLEWVS |
| P, R, S 103 FW2 sequence no. 9 | SEQ ID NO: 110 | WLRQTPGKGLEWVG |
| P, R, S 103 FW2 sequence no. 10 | SEQ ID NO: 111 | WVRQAPGKAEEFVS | and in which:

v) FR3 is an amino acid sequence that has at least 80% amino acid identity with at least one of the following amino acid sequences:

TABLE A-22

Representative FW3 sequences for Nanobodies of the P, R, S 103-group.

| | | |
|---|---|---|
| P, R, S 103 FW3 sequence no. 1 | SEQ ID NO: 112 | RFTISRDNAKNTVYLQMNS LKPEDTAVYYCAA |
| P, R, S 103 FW3 sequence no. 2 | SEQ ID NO: 113 | RFTISRDNARNTLYLQMDS LIPEDTALYYCAR |
| P, R, S 103 FW3 sequence no. 3 | SEQ ID NO: 114 | RFTISRDNAKNEMYLQMNN LKTEDTGVYVVCGA |
| P, R, S 103 FW3 sequence no. 4 | SEQ ID NO: 115 | RFTISSDSNRNMIYLQMNN LKPEDTAVYYCAA |
| P, R, S 103 FW3 sequence no. 5 | SEQ ID NO: 116 | RFTISRDNAKNMLYLHLNN LKSEDTAVYYCRR |
| P, R, S 103 FW3 sequence no. 6 | SEQ ID NO: 117 | RFTISRDNAKKTVYLRLNS LNPEDTAVYSCNL |
| P, R, S 103 FW3 sequence no. 7 | SEQ ID NO: 118 | RFKISRDNAKKTLYLQMNS LGPEDTAMYYCQR |
| P, R, S 103 FW3 sequence no. 8 | SEQ ID NO: 119 | RFTVSRDNGKNTAYLRMNS LKPEDTADYYCAV | and in which:

vi) FR4 is an amino acid sequence that has at least 80% amino acid identity with at least one of the following amino acid sequences:

TABLE A-23

Representative FW4 sequences for Nanobodies of the P, R, S 103-group.

| | | |
|---|---|---|
| P, R, S 103 FW4 sequence no. 1 | SEQ ID NO: 120 | RGQGTQVTVSS |
| P, R, S 103 FW4 sequence no. 2 | SEQ ID NO: 121 | LRGGTQVTVSS |
| P, R, S 103 FW4 sequence no. 3 | SEQ ID NO: 122 | GNKGTLVTVSS |

TABLE A-23-continued

Representative FW4 sequences for Nanobodies of the P, R, S 103-group.

| | | |
|---|---|---|
| P, R, S 103 FW4 sequence no. 4 | SEQ ID NO: 123 | SSPGTQVTVSS |
| P, R, S 103 FW4 sequence no. 5 | SEQ ID NO: 124 | SSQGTLVTVSS |
| P, R, S 103 FW4 sequence no. 6 | SEQ ID NO: 125 | RSRGIQVTVSS | and in which:

vii) CDR1, CDR2 and CDR3 are as defined herein, and are preferably as defined according to one of the preferred aspects herein, and are more preferably as defined according to one of the more preferred aspects herein.

In the above Nanobodies, one or more of the further Hallmark residues are preferably as described herein (for example, when they are $V_{HH}$ sequences or partially humanized Nanobodies).

With regard to framework 1, it will again be clear to the skilled person that, for determining the degree of amino acid identity, the amino acid residues on positions 1 to 4 and 27 to 30 are preferably disregarded.

In view of this, a Nanobody of the P, R, S 103 class may be an amino acid sequence that is comprised of four framework regions/sequences interrupted by three complementarity determining regions/sequences, in which:

i) the amino acid residue at position 103 according to the Kabat numbering is different from W;

and in which:

ii) preferably the amino acid residue at position 103 according to the Kabat numbering is P, R or S, and more preferably R;

and in which:

iii) FR1 is an amino acid sequence that, on positions 5 to 26 of the Kabat numbering, has at least 80% amino acid identity with at least one of the following amino acid sequences:

TABLE A-24

Representative FW1 sequences (amino acid residues 5 to 26) for Nanobodies of the P, R, S 103-group.

| | | |
|---|---|---|
| P, R, S 103 FW1 sequence no. 9 | SEQ ID NO: 100 | VESGGGLVQAGGSLRLSC AASG |
| P, R, S 103 FW1 sequence no. 10 | SEQ ID NO: 101 | AESGGGLVQPGGSLKLSC AASR | and in which:

iv) FR2, FR3 and FR4 are as mentioned herein for FR2, FR3 and FR4 of Nanobodies of the P, R, S 103 class;

and in which:

v) CDR1, CDR2 and CDR3 are as defined herein, and are preferably as defined according to one of the preferred aspects herein, and are more preferably as defined according to one of the more preferred aspects herein.

The above Nanobodies may for example be $V_{HH}$ sequences or may be humanized Nanobodies. When the above Nanobody sequences are $V_{HH}$ sequences, they may be suitably humanized, as further described herein. When the Nanobodies are partially humanized Nanobodies, they may optionally be further suitably humanized, again as described herein.

In the above Nanobodies, one or more of the further Hallmark residues are preferably as described herein (for example, when they are $V_{HH}$ sequences or partially humanized Nanobodies).

In another preferred, but non-limiting aspect, the invention relates to a Nanobody as described above, in which the CDR sequences have at least 70% amino acid identity, preferably at least 80% amino acid identity, more preferably at least 90% amino acid identity, such as 95% amino acid identity or more or even essentially 100% amino acid identity with the CDR sequences of at least one of the amino acid sequences of SEQ ID NO's: 2051-2325. This degree of amino acid identity can for example be determined by determining the degree of amino acid identity (in a manner described herein) between said Nanobody and one or more of the sequences of SEQ ID NO's: 2051-2325, in which the amino acid residues that form the framework regions are disregarded. Such Nanobodies can be as further described herein.

As already mentioned herein, another preferred but non-limiting aspect of the invention relates to a Nanobody with an amino acid sequence that is chosen from the group consisting of SEQ ID NO's: 2051-2325 or from the group consisting of from amino acid sequences that have more than 80%, preferably more than 90%, more preferably more than 95%, such as 99% or more sequence identity (as defined herein) with at least one of the amino acid sequences of SEQ ID NO's: 2051-2325.

Also, in the above Nanobodies:
i) any amino acid substitution (when it is not a humanizing substitution as defined herein) is preferably, and compared to the corresponding amino acid sequence of SEQ ID NO's: 2051-2325, a conservative amino acid substitution, (as defined herein);
and/or:
ii) its amino acid sequence preferably contains either only amino acid substitutions, or otherwise preferably no more than 5, preferably no more than 3, and more preferably only 1 or 2 amino acid deletions or insertions, compared to the corresponding amino acid sequence of SEQ ID NO's: 2051-2325;
and/or
iii) the CDR's may be CDR's that are derived by means of maturation, for example starting from the CDR's of to the corresponding amino acid sequence of SEQ ID NO's: 2051-2325.

Preferably, the CDR sequences and FR sequences in the Nanobodies of the invention are such that the Nanobodies of the invention (and polypeptides of the invention comprising the same):
bind to HER2 with a dissociation constant ($K_D$) of $10^{-5}$ to $10^{-12}$ moles/liter or less, and preferably $10^{-7}$ to $10^{-12}$ moles/liter or less and more preferably $10^{-8}$ to $10^{-12}$ moles/liter (i.e. with an association constant ($K_A$) of $10^5$ to $10^{12}$ liter/moles or more, and preferably $10^7$ to $10^{12}$ liter/moles or more and more preferably $10^8$ to $10^{12}$ liter/moles);
and/or such that they:
bind to HER2 with a $k_{on}$-rate of between $10^2$ $M^{-1}$ $s^{-1}$ to about $10^7$ $M^{-1}$ $s^{-1}$, preferably between $10^3$ $M^{-1}$ $s^{-1}$ and $10^7$ $M^{-1}$ $s^{-1}$, more preferably between $10^4$ $M^{-1}$ $s^{-1}$ and $10^7$ $M^{-1}$ $s^{-1}$, such as between $10^5$ $M^{-1}$ $s^{-1}$ and $10^7$ $M^{-1}$ $s^{-1}$;
and/or such that they:
bind to HER2 with a $k_{off}$-rate between 1 $s^{-1}$ ($t_{1/2}$=0.69 s) and $10^{-6}$ $s^{-1}$ (providing a near irreversible complex with a $t_{1/2}$ of multiple days), preferably between $10^{-2}$ $s^{-1}$ and $10^{-6}$ $s^{-1}$, more preferably between $10^{-3}$ $s^{-1}$ and $10^{-6}$ $s^{-1}$, such as between $10^{-4}$ $s^{-1}$ and $10^{-6}$ $s^{-1}$.

Preferably, CDR sequences and FR sequences present in the Nanobodies of the invention are such that the Nanobodies of the invention will bind to HER2 with an affinity less than 500 nM, preferably less than 200 nM, more preferably less than 10 nM, such as less than 500 pM.

According to one non-limiting aspect of the invention, a Nanobody may be as defined herein, but with the proviso that it has at least "one amino acid difference" (as defined herein) in at least one of the framework regions compared to the corresponding framework region of a naturally occurring human $V_H$ domain, and in particular compared to the corresponding framework region of DP-47. More specifically, according to one non-limiting aspect of the invention, a Nanobody may be as defined herein, but with the proviso that it has at least "one amino acid difference" (as defined herein) at least one of the Hallmark residues (including those at positions 108, 103 and/or 45) compared to the corresponding framework region of a naturally occurring human $V_H$ domain, and in particular compared to the corresponding framework region of DP-47. Usually, a Nanobody will have at least one such amino acid difference with a naturally occurring $V_H$ domain in at least one of FR2 and/or FR4, and in particular at least one of the Hallmark residues in FR2 and/or FR4 (again, including those at positions 108, 103 and/or 45).

Also, a humanized Nanobody of the invention may be as defined herein, but with the proviso that it has at least "one amino acid difference" (as defined herein) in at least one of the framework regions compared to the corresponding framework region of a naturally occurring $V_{HH}$ domain. More specifically, according to one non-limiting aspect of the invention, a humanized Nanobody may be as defined herein, but with the proviso that it has at least "one amino acid difference" (as defined herein) at least one of the Hallmark residues (including those at positions 108, 103 and/or 45) compared to the corresponding framework region of a naturally occurring $V_{HH}$ domain. Usually, a humanized Nanobody will have at least one such amino acid difference with a naturally occurring $V_{HH}$ domain in at least one of FR2 and/or FR4, and in particular at least one of the Hallmark residues in FR2 and/or FR4 (again, including those at positions 108, 103 and/or 45).

As will be clear from the disclosure herein, it is also within the scope of the invention to use natural or synthetic analogs, mutants, variants, alleles, homologs and orthologs (herein collectively referred to as "analogs") of the Nanobodies of the invention as defined herein, and in particular analogs of the Nanobodies of SEQ ID NO's 2051-2325. Thus, according to one aspect of the invention, the term "Nanobody of the invention" in its broadest sense also covers such analogs.

Generally, in such analogs, one or more amino acid residues may have been replaced, deleted and/or added, compared to the Nanobodies of the invention as defined herein. Such substitutions, insertions or deletions may be made in one or more of the framework regions and/or in one or more of the CDR's. When such substitutions, insertions or deletions are made in one or more of the framework regions, they may be made at one or more of the Hallmark residues and/or at one or more of the other positions in the framework residues, although substitutions, insertions or deletions at the Hallmark residues are generally less preferred (unless these are suitable humanizing substitutions as described herein).

By means of non-limiting examples, a substitution may for example be a conservative substitution (as described herein) and/or an amino acid residue may be replaced by another amino acid residue that naturally occurs at the same position in another $V_{HH}$ domain (see Tables A-5 to A-8 for some non-limiting examples of such substitutions), although the invention is generally not limited thereto. Thus, any one or more substitutions, deletions or insertions, or any combination thereof, that either improve the properties of the Nanobody of the invention or that at least do not detract too much from the desired properties or from the balance or combination of desired properties of the Nanobody of the invention (i.e. to the extent that the Nanobody is no longer suited for its intended use) are included within the scope of the invention. A skilled person will generally be able to determine and select suitable substitutions, deletions or insertions, or suitable combinations of thereof, based on the disclosure herein and optionally after a limited degree of routine experimentation, which may for example involve introducing a limited number of possible substitutions and determining their influence on the properties of the Nanobodies thus obtained.

For example, and depending on the host organism used to express the Nanobody or polypeptide of the invention, such deletions and/or substitutions may be designed in such a way that one or more sites for post-translational modification (such as one or more glycosylation sites) are removed, as will be within the ability of the person skilled in the art. Alternatively, substitutions or insertions may be designed so as to introduce one or more sites for attachment of functional groups (as described herein), for example to allow site-specific pegylation (again as described herein).

As can be seen from the data on the $V_{HH}$ entropy and $V_{HH}$ variability given in Tables A-5 to A-8 above, some amino acid residues in the framework regions are more conserved than others. Generally, although the invention in its broadest sense is not limited thereto, any substitutions, deletions or insertions are preferably made at positions that are less conserved. Also, generally, amino acid substitutions are preferred over amino acid deletions or insertions.

The analogs are preferably such that they can bind to HER2 with an affinity (suitably measured and/or expressed as a $K_D$-value (actual or apparent), a $K_A$-value (actual or apparent), a $k_{on}$-rate and/or a $k_{off}$ rate, or alternatively as an $IC_{50}$ value, as further described herein) that is as defined herein for the Nanobodies of the invention.

The analogs are preferably also such that they retain the favourable properties the Nanobodies, as described herein.

Also, according to one preferred aspect, the analogs have a degree of sequence identity of at least 70%, preferably at least 80%, more preferably at least 90%, such as at least 95% or 99% or more; and/or preferably have at most 20, preferably at most 10, even more preferably at most 5, such as 4, 3, 2 or only 1 amino acid difference (as defined herein), with one of the Nanobodies of SEQ ID NOs: 2051-2325.

Also, the framework sequences and CDR's of the analogs are preferably such that they are in accordance with the preferred aspects defined herein. More generally, as described herein, the analogs will have (a) a Q at position 108; and/or (b) a charged amino acid or a cysteine residue at position 45 and preferably an E at position 44, and more preferably E at position 44 and R at position 45; and/or (c) P, R or S at position 103.

One preferred class of analogs of the Nanobodies of the invention comprise Nanobodies that have been humanized (i.e. compared to the sequence of a naturally occurring Nanobody of the invention). As mentioned in the background art cited herein, such humanization generally involves replacing one or more amino acid residues in the sequence of a naturally occurring $V_{HH}$ with the amino acid residues that occur at the same position in a human $V_H$ domain, such as a human $V_H3$ domain. Examples of possible humanizing substitutions or combinations of humanizing substitutions will be clear to the skilled person, for example from the Tables herein, from the possible humanizing substitutions mentioned in the background art cited herein, and/or from a comparison between the sequence of a Nanobody and the sequence of a naturally occurring human $V_H$ domain.

The humanizing substitutions should be chosen such that the resulting humanized Nanobodies still retain the favourable properties of Nanobodies as defined herein, and more preferably such that they are as described for analogs in the preceding paragraphs. A skilled person will generally be able to determine and select suitable humanizing substitutions or suitable combinations of humanizing substitutions, based on the disclosure herein and optionally after a limited degree of routine experimentation, which may for example involve introducing a limited number of possible humanizing substitutions and determining their influence on the properties of the Nanobodies thus obtained.

Generally, as a result of humanization, the Nanobodies of the invention may become more "human-like", while still retaining the favorable properties of the Nanobodies of the invention as described herein. As a result, such humanized Nanobodies may have several advantages, such as a reduced immunogenicity, compared to the corresponding naturally occurring $V_{HH}$ domains. Again, based on the disclosure herein and optionally after a limited degree of routine experimentation, the skilled person will be able to select humanizing substitutions or suitable combinations of humanizing substitutions which optimize or achieve a desired or suitable balance between the favourable properties provided by the humanizing substitutions on the one hand and the favourable properties of naturally occurring $V_{HH}$ domains on the other hand.

The Nanobodies of the invention may be suitably humanized at any framework residue(s), such as at one or more Hallmark residues (as defined herein) or at one or more other framework residues (i.e. non-Hallmark residues) or any suitable combination thereof. One preferred humanizing substitution for Nanobodies of the "P,R,S-103 group" or the "KERE group" is Q108 into L108. Nanobodies of the "GLEW class" may also be humanized by a Q108 into L108 substitution, provided at least one of the other Hallmark residues contains a camelid (camelizing) substitution (as defined herein). For example, as mentioned above, one particularly preferred class of humanized Nanobodies has GLEW (SEQ ID NO: 2447) or a GLEW-like sequence at positions 44-47; P, R or S (and in particular R) at position 103, and an L at position 108.

The humanized and other analogs, and nucleic acid sequences encoding the same, can be provided in any manner known per se. For example, the analogs can be obtained by providing a nucleic acid that encodes a naturally occurring $V_{HH}$ domain, changing the codons for the one or more amino acid residues that are to be substituted into the codons for the corresponding desired amino acid residues (e.g. by site-directed mutagenesis or by PCR using suitable mismatch primers), expressing the nucleic acid/nucleotide sequence thus obtained in a suitable host or expression system; and optionally isolating and/or purifying the analog thus obtained to provide said analog in essentially isolated form (e.g. as further described herein). This can generally be performed using methods and techniques known per se, which will be clear to the skilled person, for example from the handbooks and references cited herein, the background art cited herein and/or from the further description herein. Alternatively, a nucleic acid encoding the desired analog can be synthesized in a manner known per se (for example using an automated apparatus for synthesizing nucleic acid sequences with a predefined amino acid sequence) and can then be expressed as described herein. Yet another technique may involve combining one or more naturally occurring and/or synthetic nucleic acid sequences each encoding a part of the desired analog, and then expressing the combined nucleic acid sequence as described herein. Also, the analogs can be provided using chemical synthesis of the pertinent amino acid sequence using techniques for peptide synthesis known per se, such as those mentioned herein.

In this respect, it will be also be clear to the skilled person that the Nanobodies of the invention (including their analogs) can be designed and/or prepared starting from human $V_H$ sequences (i.e. amino acid sequences or the corresponding nucleotide sequences), such as for example from human $V_H3$ sequences such as DP-47, DP-51 or DP-29, i.e. by introducing one or more camelizing substitutions (i.e. changing one or more amino acid residues in the amino acid sequence of said human $V_H$ domain into the amino acid residues that occur at the corresponding position in a $V_{HH}$ domain), so as to provide the sequence of a Nanobody of the invention and/or so as to confer the favourable properties of a Nanobody to the sequence thus obtained. Again, this can generally be performed using the various methods and techniques referred to in the previous paragraph, using an amino acid sequence and/or nucleotide sequence for a human $V_H$ domain as a starting point.

Some preferred, but non-limiting camelizing substitutions can be derived from Tables A-5-A-8. It will also be clear that camelizing substitutions at one or more of the Hallmark residues will generally have a greater influence on the desired properties than substitutions at one or more of the other amino acid positions, although both and any suitable combination thereof are included within the scope of the invention. For example, it is possible to introduce one or more camelizing substitutions that already confer at least some the desired properties, and then to introduce further camelizing substitutions that either further improve said properties and/or confer additional favourable properties. Again, the skilled person will generally be able to determine and select suitable camelizing substitutions or suitable combinations of camelizing substitutions, based on the disclosure herein and optionally after a limited degree of routine experimentation, which may for example involve introducing a limited number of possible camelizing substitutions and determining whether the favourable properties of Nanobodies are obtained or improved (i.e. compared to the original $V_H$ domain). Generally, however, such camelizing substitutions are preferably such that the resulting an amino acid sequence at least contains (a) a Q at position 108; and/or (b) a charged amino acid or a cysteine residue at position 45 and preferably also an E at position 44, and more preferably E at position 44 and R at position 45; and/or (c) P, R or S at position 103; and optionally one or more further camelizing substitutions. More preferably, the camelizing substitutions are such that they result in a Nanobody of the invention and/or in an analog thereof (as defined herein), such as in a humanized analog and/or preferably in an analog that is as defined in the preceding paragraphs.

As will also be clear from the disclosure herein, it is also within the scope of the invention to use parts or fragments, or combinations of two or more parts or fragments, of the Nanobodies of the invention as defined herein, and in particular parts or fragments of the Nanobodies of SEQ ID NO's: 2051-2325. Thus, according to one aspect of the invention, the term "Nanobody of the invention" in its broadest sense also covers such parts or fragments.

Generally, such parts or fragments of the Nanobodies of the invention (including analogs thereof) have amino acid sequences in which, compared to the amino acid sequence of the corresponding full length Nanobody of the invention (or analog thereof), one or more of the amino acid residues at the N-terminal end, one or more amino acid residues at the C-terminal end, one or more contiguous internal amino acid residues, or any combination thereof, have been deleted and/or removed.

The parts or fragments are preferably such that they can bind to HER2 with an affinity (suitably measured and/or expressed as a $K_D$-value (actual or apparent), a $K_A$-value (actual or apparent), a $k_{on}$-rate and/or a $k_{off}$-rate, or alternatively as an $IC_{50}$ value, as further described herein) that is as defined herein for the Nanobodies of the invention.

Any part or fragment is preferably such that it comprises at least 10 contiguous amino acid residues, preferably at least 20 contiguous amino acid residues, more preferably at least 30 contiguous amino acid residues, such as at least 40 contiguous amino acid residues, of the amino acid sequence of the corresponding full length Nanobody of the invention.

Also, any part or fragment is such preferably that it comprises at least one of CDR1, CDR2 and/or CDR3 or at least part thereof (and in particular at least CDR3 or at least part thereof). More preferably, any part or fragment is such that it comprises at least one of the CDR's (and preferably at least CDR3 or part thereof) and at least one other CDR (i.e. CDR1 or CDR2) or at least part thereof, preferably connected by suitable framework sequence(s) or at least part thereof. More preferably, any part or fragment is such that it comprises at least one of the CDR's (and preferably at least CDR3 or part thereof) and at least part of the two remaining CDR's, again preferably connected by suitable framework sequence(s) or at least part thereof.

According to another particularly preferred, but non-limiting aspect, such a part or fragment comprises at least CDR3, such as FR3, CDR3 and FR4 of the corresponding full length Nanobody of the invention, i.e. as for example described in the International application WO 03/050531 (Lasters et al.).

As already mentioned above, it is also possible to combine two or more of such parts or fragments (i.e. from the same or different Nanobodies of the invention), i.e. to provide an analog (as defined herein) and/or to provide further parts or fragments (as defined herein) of a Nanobody of the invention. It is for example also possible to combine one or more parts or fragments of a Nanobody of the invention with one or more parts or fragments of a human $V_H$ domain.

According to one preferred aspect, the parts or fragments have a degree of sequence identity of at least 50%, preferably at least 60%, more preferably at least 70%, even more preferably at least 80%, such as at least 90%, 95% or 99% or more with one of the Nanobodies of SEQ ID NOs: 2051-2325.

The parts and fragments, and nucleic acid sequences encoding the same, can be provided and optionally combined in any manner known per se. For example, such parts or fragments can be obtained by inserting a stop codon in a nucleic acid that encodes a full-sized Nanobody of the invention, and then expressing the nucleic acid thus obtained in a manner known per se (e.g. as described herein). Alternatively, nucleic acids encoding such parts or fragments can be obtained by suitably restricting a nucleic acid that encodes a full-sized Nanobody of the invention or by synthesizing such a nucleic acid in a manner known per se. Parts or fragments may also be provided using techniques for peptide synthesis known per se.

The invention in its broadest sense also comprises derivatives of the Nanobodies of the invention. Such derivatives can generally be obtained by modification, and in particular by chemical and/or biological (e.g. enzymatical) modification, of the Nanobodies of the invention and/or of one or more of the amino acid residues that form the Nanobodies of the invention.

Examples of such modifications, as well as examples of amino acid residues within the Nanobody sequence that can be modified in such a manner (i.e. either on the protein backbone but preferably on a side chain), methods and techniques that can be used to introduce such modifications and the potential uses and advantages of such modifications will be clear to the skilled person.

For example, such a modification may involve the introduction (e.g. by covalent linking or in an other suitable manner) of one or more functional groups, residues or moieties into or onto the Nanobody of the invention, and in particular of one or more functional groups, residues or moieties that confer one or more desired properties or functionalities to the Nanobody of the invention. Example of such functional groups will be clear to the skilled person.

For example, such modification may comprise the introduction (e.g. by covalent binding or in any other suitable manner) of one or more functional groups that increase the half-life, the solubility and/or the absorption of the Nanobody of the invention, that reduce the immunogenicity and/or the toxicity of the Nanobody of the invention, that eliminate or attenuate any undesirable side effects of the Nanobody of the invention, and/or that confer other advantageous properties to and/or reduce the undesired properties of the Nanobodies and/or polypeptides of the invention; or any combination of two or more of the foregoing. Examples of such functional groups and of techniques for introducing them will be clear to the skilled person, and can generally comprise all functional groups and techniques mentioned in the general background art cited hereinabove as well as the functional groups and techniques known per se for the modification of pharmaceutical proteins, and in particular for the modification of antibodies or antibody fragments (including ScFv's and single domain antibodies), for which reference is for example made to Remington's Pharmaceutical Sciences, 16th ed., Mack Publishing Co., Easton, Pa. (1980). Such functional groups may for example be linked directly (for example covalently) to a Nanobody of the invention, or optionally via a suitable linker or spacer, as will again be clear to the skilled person.

One of the most widely used techniques for increasing the half-life and/or reducing the immunogenicity of pharmaceutical proteins comprises attachment of a suitable pharmacologically acceptable polymer, such as poly(ethyleneglycol) (PEG) or derivatives thereof (such as methoxypoly(ethyleneglycol) or mPEG). Generally, any suitable form of pegylation can be used, such as the pegylation used in the art for antibodies and antibody fragments (including but not limited to (single) domain antibodies and ScFv's); reference is made to for example Chapman, Nat. Biotechnol., 54, 531-545 (2002); by Veronese and Harris, Adv. Drug Deliv. Rev. 54, 453-456 (2003), by Harris and Chess, Nat. Rev. Drug. Discov. 2, (2003) and in WO 04/060965. Various reagents for pegylation of proteins are also commercially available, for example from Nektar Therapeutics, USA.

Preferably, site-directed pegylation is used, in particular via a cysteine-residue (see for example Yang et al., Protein Engineering, 16, 10, 761-770 (2003). For example, for this purpose, PEG may be attached to a cysteine residue that naturally occurs in a Nanobody of the invention, a Nanobody of the invention may be modified so as to suitably introduce one or more cysteine residues for attachment of PEG, or an amino acid sequence comprising one or more cysteine residues for attachment of PEG may be fused to the N- and/or C-terminus of a Nanobody of the invention, all using techniques of protein engineering known per se to the skilled person.

Preferably, for the Nanobodies and proteins of the invention, a PEG is used with a molecular weight of more than 5000, such as more than 10,000 and less than 200,000, such as less than 100,000; for example in the range of 20,000-80,000.

Another, usually less preferred modification comprises N-linked or O-linked glycosylation, usually as part of co-translational and/or post-translational modification, depending on the host cell used for expressing the Nanobody or polypeptide of the invention.

Yet another modification may comprise the introduction of one or more detectable labels or other signal-generating groups or moieties, depending on the intended use of the labelled Nanobody. Suitable labels and techniques for attaching, using and detecting them will be clear to the skilled person, and for example include, but are not limited to, fluorescent labels (such as fluorescein, isothiocyanate, rhodamine, phycoerythrin, phycocyanin, allophycocyanin, o-phthaldehyde, and fluorescamine and fluorescent metals such as $^{152}$Eu or others metals from the lanthanide series), phosphorescent labels, chemiluminescent labels or bioluminescent labels (such as luminal, isoluminol, theromatic acridinium ester, imidazole, acridinium salts, oxalate ester, dioxetane or GFP and its analogs), radio-isotopes (such as $^{3}$H, $^{125}$I, $^{32}$P, $^{35}$S, $^{14}$C, $^{51}$Cr, $^{36}$Cl, $^{57}$Co, $^{58}$Co, $^{59}$Fe, and $^{75}$Se), metals, metal chelates or metallic cations (for example metallic cations such as $^{99m}$Tc, $^{123}$I, $^{111}$In, $^{131}$I, $^{97}$Ru, $^{67}$Cu, $^{67}$Ga, and $^{68}$Ga or other metals or metallic cations that are particularly suited for use in in vivo, in vitro or in situ diagnosis and imaging, such as ($^{157}$Gd, $^{55}$Mn, $^{162}$Dy, $^{52}$Cr, and $^{56}$Fe), as well as chromophores and enzymes (such as malate dehydrogenase, staphylococcal nuclease, delta-V-steroid isomerase, yeast alcohol dehydrogenase, alpha-glycerophosphate dehydrogenase, triose phosphate isomerase, biotinavidin peroxidase, horseradish peroxidase, alkaline phosphatase, asparaginase, glucose oxidase, beta-galactosidase, ribonuclease, urease, catalase, glucose-VI-phosphate dehydrogenase, glucoamylase and acetylcholine esterase). Other suitable labels will be clear to the skilled person, and for example include moieties that can be detected using NMR or ESR spectroscopy.

Such labelled Nanobodies and polypeptides of the invention may for example be used for in vitro, in vivo or in situ assays (including immunoassays known per se such as ELISA, RIA, ETA and other "sandwich assays", etc.) as well as in vivo diagnostic and imaging purposes, depending on the choice of the specific label.

As will be clear to the skilled person, another modification may involve the introduction of a chelating group, for example to chelate one of the metals or metallic cations referred to above. Suitable chelating groups for example include, without limitation, diethylenetriaminepentaacetic acid (DTPA) or ethylenediaminetetraacetic acid (EDTA).

Yet another modification may comprise the introduction of a functional group that is one part of a specific binding pair, such as the biotin-(strept)avidin binding pair, Such a functional group may be used to link the Nanobody of the invention to another protein, polypeptide or chemical compound that is bound to the other half of the binding pair, i.e. through formation of the binding pair. For example, a Nanobody of the invention may be conjugated to biotin, and linked to another protein, polypeptide, compound or carrier conjugated to avidin or streptavidin. For example, such a conjugated Nanobody may be used as a reporter, for example in a diagnostic system where a detectable signal-producing agent is conjugated to avidin or streptavidin. Such binding pairs may for example also be used to bind the Nanobody of the invention to a carrier, including carriers suitable for pharmaceutical purposes. One non-limiting example are the liposomal formulations described by Cao and Suresh, Journal of Drug Targeting, 8, 4, 257 (2000). Such binding pairs may also be used to link a therapeutically active agent to the Nanobody of the invention.

For some applications, in particular for those applications in which it is intended to kill a cell that expresses the target against which the Nanobodies of the invention are directed (e.g. in the treatment of cancer), or to reduce or slow the growth and/or proliferation such a cell, the Nanobodies of the invention may also be linked to a toxin or to a toxic residue or moiety. Examples of toxic moieties, compounds or residues which can be linked to a Nanobody of the invention to provide—for example—a cytotoxic compound will be clear to the skilled person and can for example be found in the prior art cited above and/or in the further description herein. One example is the so-called ADEPT™ technology described in WO 03/055527.

Other potential chemical and enzymatical modifications will be clear to the skilled person. Such modifications may also be introduced for research purposes (e.g. to study function-activity relationships). Reference is for example made to Lundblad and Bradshaw, Biotechnol. Appl. Biochem., 26, 143-151 (1997).

Preferably, the derivatives are such that they bind to HER2 with an affinity (suitably measured and/or expressed as a $K_D$-value (actual or apparent), a $K_A$-value (actual or apparent), a $k_{on}$-rate and/or a $k_{off}$-rate, or alternatively as an $IC_{50}$ value, as further described herein) that is as defined herein for the Nanobodies of the invention.

As mentioned above, the invention also relates to proteins or polypeptides that essentially consist of or comprise at least one Nanobody of the invention. By "essentially consist of" is meant that the amino acid sequence of the polypeptide of the invention either is exactly the same as the amino acid sequence of a Nanobody of the invention or corresponds to the amino acid sequence of a Nanobody of the invention which has a limited number of amino acid residues, such as 1-20 amino acid residues, for example 1-10 amino acid residues and preferably 1-6 amino acid residues, such as 1, 2, 3, 4, 5 or 6 amino acid residues, added at the amino terminal end, at the carboxy terminal end, or at both the amino terminal end and the carboxy terminal end of the amino acid sequence of the Nanobody.

Said amino acid residues may or may not change, alter or otherwise influence the (biological) properties of the Nanobody and may or may not add further functionality to the Nanobody. For example, such amino acid residues:

can comprise an N-terminal Met residue, for example as result of expression in a heterologous host cell or host organism.

may form a signal sequence or leader sequence that directs secretion of the Nanobody from a host cell upon synthesis. Suitable secretory leader peptides will be clear to the skilled person, and may be as further described herein. Usually, such a leader sequence will be linked to the N-terminus of the Nanobody, although the invention in its broadest sense is not limited thereto;

may form a sequence or signal that allows the Nanobody to be directed towards and/or to penetrate or enter into specific organs, tissues, cells, or parts or compartments of cells, and/or that allows the Nanobody to penetrate or cross a biological barrier such as a cell membrane, a cell layer such as a layer of epithelial cells, a tumor including solid tumors, or the blood-brain-barrier. Examples of such amino acid sequences will be clear to the skilled person. Some non-limiting examples are the small peptide vectors ("Pep-trans vectors") described in WO 03/026700 and in Temsamani et al., Expert Opin. Biol. Ther., 1, 773 (2001); Temsamani and Vidal, Drug Discov. Today, 9, 1012 (004) and Rousselle, J. Pharmacol. Exp. Ther., 296, 124-131 (2001), and the membrane translocator sequence described by Zhao et al., Apoptosis, 8, 631-637 (2003). C-terminal and N-terminal amino acid sequences for intracellular targeting of antibody fragments are for example described by Cardinale et al., Methods, 34, 171 (2004). Other suitable techniques for intracellular targeting involve the expression and/or use of so-called "intrabodies" comprising a Nanobody of the invention, as mentioned below;

may form a "tag", for example an amino acid sequence or residue that allows or facilitates the purification of the Nanobody, for example using affinity techniques directed against said sequence or residue. Thereafter, said sequence or residue may be removed (e.g. by chemical or enzymatical cleavage) to provide the Nanobody sequence (for this purpose, the tag may optionally be linked to the Nanobody sequence via a cleavable linker sequence or contain a cleavable motif). Some preferred, but non-limiting examples of such residues are multiple histidine residues, glutatione residues and a myc-tag (see for example SEQ ID NO:31 of WO 06/12282).

may be one or more amino acid residues that have been functionalized and/or that can serve as a site for attachment of functional groups. Suitable amino acid residues and functional groups will be clear to the skilled person and include, but are not limited to, the amino acid residues and functional groups mentioned herein for the derivatives of the Nanobodies of the invention.

According to another aspect, a polypeptide of the invention comprises a Nanobody of the invention, which is fused at its amino terminal end, at its carboxy terminal end, or both at its amino terminal end and at its carboxy terminal end to at least one further amino acid sequence, i.e. so as to provide a fusion protein comprising said Nanobody of the invention and the one or more further amino acid sequences. Such a fusion will also be referred to herein as a "Nanobody fusion".

The one or more further amino acid sequence may be any suitable and/or desired amino acid sequences. The further amino acid sequences may or may not change, alter or otherwise influence the (biological) properties of the Nanobody, and may or may not add further functionality to the Nanobody or the polypeptide of the invention. Preferably, the further amino acid sequence is such that it confers one or more desired properties or functionalities to the Nanobody or the polypeptide of the invention.

For example, the further amino acid sequence may also provide a second binding site, which binding site may be directed against any desired protein, polypeptide, antigen, antigenic determinant or epitope (including but not limited to the same protein, polypeptide, antigen, antigenic determinant or epitope against which the Nanobody of the invention is directed, or a different protein, polypeptide, antigen, antigenic determinant or epitope).

Example of such amino acid sequences will be clear to the skilled person, and may generally comprise all amino acid sequences that are used in peptide fusions based on conventional antibodies and fragments thereof (including but not limited to ScFv's and single domain antibodies). Reference is for example made to the review by Holliger and Hudson, Nature Biotechnology, 23, 9, 1126-1136 (2005).

For example, such an amino acid sequence may be an amino acid sequence that increases the half-life, the solubility, or the absorption, reduces the immunogenicity or the toxicity, eliminates or attenuates undesirable side effects, and/or confers other advantageous properties to and/or reduces the undesired properties of the polypeptides of the invention, compared to the Nanobody of the invention per se. Some non-limiting examples of such amino acid sequences are serum proteins, such as human serum albumin (see for example WO 00/27435) or haptenic molecules (for example haptens that are recognized by circulating antibodies, see for example WO 98/22141).

In particular, it has been described in the art that linking fragments of immunoglobulins (such as $V_H$ domains) to serum albumin or to fragments thereof can be used to increase the half-life. Reference is for made to WO 00/27435 and WO 01/077137). According to the invention, the Nanobody of the invention is preferably either directly linked to serum albumin (or to a suitable fragment thereof) or via a suitable linker, and in particular via a suitable peptide linked so that the polypeptide of the invention can be expressed as a genetic fusion (protein). According to one specific aspect, the Nanobody of the invention may be linked, to a fragment of serum albumin that at least comprises the domain III of serum albumin or part thereof. Reference is for example made to WO 07/112,940 of Ablynx N.V.

Alternatively, the further amino acid sequence may provide a second binding site or binding unit that is directed against a serum protein (such as, for example, human serum albumin or another serum protein such as IgG), so as to provide increased half-life in serum. Such amino acid sequences for example include the Nanobodies described below, as well as the small peptides and binding proteins described in WO 91/01743, WO 01/45746 and WO 02/076489 and the dAb's described in WO 03/002609 and WO 04/003019. Reference is also made to Harmsen et al., Vaccine, 23 (41); 4926-42, 2005, as well as to EP 0 368 684, as well as to WO 08/028,977, WO 08/043,821, WO 08/043, 822 by Ablynx N.V. mentioned herein and WO 08/068,280 by Ablynx N.V.

Such amino acid sequences may in particular be directed against serum albumin (and more in particular human serum albumin) and/or against IgG (and more in particular human IgG). For example, such amino acid sequences may be amino acid sequences that are directed against (human) serum albumin and amino acid sequences that can bind to amino acid residues on (human) serum albumin that are not involved in binding of serum albumin to FcRn (see for example WO 06/0122787) and/or amino acid sequences that are capable of binding to amino acid residues on serum albumin that do not form part of domain III of serum albumin (see again for example WO 06/0122787); amino acid sequences that have or can provide an increased half-life (see for example WO 08/028,977); amino acid sequences against human serum albumin that are cross-reactive with serum albumin from at least one species of mammal, and in particular with at least one species of primate (such as, without limitation, monkeys from the genus *Macaca* (such as, and in particular, cynomologus monkeys (*Macaca fascicularis*) and/or rhesus monkeys (*Macaca mulatta*)) and baboon (*Papio ursinus*), reference is again made to WO 2008/028977); amino acid sequences that can bind to serum albumin in a pH independent manner (see for example WO2008/043821) and/or amino acid sequences that are conditional binders (see for example WO2008/043822).

According to another aspect, the one or more further amino acid sequences may comprise one or more parts, fragments or domains of conventional 4-chain antibodies (and in particular human antibodies) and/or of heavy chain antibodies. For example, although usually less preferred, a Nanobody of the invention may be linked to a conventional (preferably human) $V_H$ or $V_L$ domain or to a natural or synthetic analog of a $V_H$ or $V_L$ domain, again optionally via a linker sequence (including but not limited to other (single) domain antibodies, such as the dAb's described by Ward et al.).

The at least one Nanobody may also be linked to one or more (preferably human) $C_H1$, $C_H2$ and/or $C_H3$ domains, optionally via a linker sequence. For instance, a Nanobody linked to a suitable $C_H1$ domain could for example be used—together with suitable light chains—to generate antibody fragments/structures analogous to conventional Fab fragments or F(ab')$_2$ fragments, but in which one or (in case of an F(ab')$_2$ fragment) one or both of the conventional $V_H$ domains have been replaced by a Nanobody of the invention. Also, two Nanobodies could be linked to a $C_H3$ domain (optionally via a linker) to provide a construct with increased half-life in vivo.

According to one specific aspect of a polypeptide of the invention, one or more Nanobodies of the invention may be linked (optionally via a suitable linker or hinge region) to one or more constant domains (for example, 2 or 3 constant domains that can be used as part of/to form an Fc portion), to an Fc portion and/or to one or more antibody parts, fragments or domains that confer one or more effector functions to the polypeptide of the invention and/or may confer the ability to bind to one or more Fc receptors. For example, for this purpose, and without being limited thereto, the one or more further amino acid sequences may comprise one or more $C_H2$ and/or $C_H3$ domains of an antibody, such as from a heavy chain antibody (as described herein) and more preferably from a conventional human 4-chain antibody; and/or may form (part of) and Fc region, for example from IgG (e.g. from IgG1, IgG2, IgG3 or IgG4), from IgE or from another human Ig such as IgA, IgD or IgM. For example, WO 94/04678 describes heavy chain antibodies comprising a Camelid $V_{HH}$ domain or a humanized derivative thereof (i.e. a Nanobody), in which the Camelidae $C_H2$ and/or $C_H3$ domain have been replaced by human $C_H2$ and $C_H3$ domains, so as to provide an immunoglobulin that consists of 2 heavy chains each comprising a Nanobody and human $C_H2$ and $C_H3$ domains (but no $C_H1$ domain), which immunoglobulin has the effector function provided by the $C_H2$ and $C_H3$ domains and which immunoglobulin can function without the presence of any light chains. Other amino acid sequences that can be suitably linked to the Nanobodies of the invention so as to provide an effector function will be clear to the skilled person, and may be chosen on the basis of the desired effector function(s). Reference is for example made to WO 04/058820, WO 99/42077, WO 02/056910 and WO 05/017148, as well as the review by Holliger and Hudson, supra and to the U.S. provisional application 61/005,324 entitled "Constructs comprising single variable domains and an Fc portion derived from IgE" filed on Dec. 4, 2007 (see also the International patent application by Ablynx N.V. entitled "Constructs comprising single variable domains and an Fc portion derived from IgE" with the same filing date as the present application) which is incorporated herein by reference.

The amino acids sequences or Nanobodies of the invention may, for example, be linked to an Fc portion that is capable of effecting one or more IgE-mediated immune responses and/or that is capable of binding to either the FcεRI receptor and/or the FcεRII receptor. The amino acid sequences or Nanobodies of the invention may be linked, optionally via a suitable linker or hinge region, to one or more constant domains, in which the constant domains from the first polypeptide chain and the second polypeptide chains together form an Fc portion that is capable of effecting one or more IgE-mediated immune responses and/or that is capable of binding to either the FcεRI receptor and/or the FcεRII receptor. In a preferred aspect, the Fc portion is capable of binding to FcεRI with an affinity (expressed as the $K_a$ value) better than $10^6$ M$^{-1}$, preferably better than $10^8$ M$^{-1}$, more preferably better than $10^9$ M$^{-1}$, such as with a $K_a$ value of about $10^{10}$ M$^{-1}$ or $10^{11}$ M$^{-1}$. More preferably the Fc portion is capable of binding to FcεRI even with an affinity (expressed as the $K_a$ value) better than $10^6$ M$^{-1}$, preferably better than $10^7$ M$^{-1}$, such as with a $K_a$ value of about $10^8$ M$^{-1}$. Such an Fc portion may comprises one or more parts, fragments, amino acid stretches or domains of the Fc portion of IgE, preferably one or more of those parts, fragments, amino acid stretches or domains of the Fc portion of IgE that allow IgE to bind to its receptors. Preferably the Fc portion at least comprises $C_ε4$ (or a suitable part of fragment thereof), and optionally also comprises $C_ε3$ (or a suitable part of fragment thereof) and/or $C_ε2$ (or a suitable part of fragment thereof). Even more preferably, the Fc portion essentially consist of three constant domains, preferably all or essentially all derived from human Fc portions.

Coupling of a Nanobody of the invention to an Fc portion may also lead to an increased half-life, compared to the corresponding Nanobody of the invention. For some applications, the use of an Fc portion and/or of constant domains (i.e. $C_H2$ and/or $C_H3$ domains) that confer increased half-life without any biologically significant effector function may also be suitable or even preferred. Other suitable constructs comprising one or more Nanobodies and one or more constant domains with increased half-life in vivo will be clear to the skilled person, and may for example comprise two Nanobodies linked to a $C_H3$ domain, optionally via a linker sequence. Generally, any fusion protein or derivatives with increased half-life will preferably have a molecular weight of more than 50 kD, the cut-off value for renal absorption.

In another one specific, but non-limiting, aspect, in order to form a polypeptide of the invention, one or more amino acid sequences of the invention may be linked (optionally via a suitable linker or hinge region) to naturally occurring, synthetic or semisynthetic constant domains (or analogs, variants, mutants, parts or fragments thereof) that have a reduced (or essentially no) tendency to self-associate into dimers (i.e. compared to constant domains that naturally occur in conventional 4-chain antibodies). Such monomeric (i.e. not self-associating) Fc chain variants, or fragments thereof, will be clear to the skilled person. For example, Helm et al., J Biol Chem 1996 271 7494, describe monomeric Fcε chain variants that can be used in the polypeptide chains of the invention.

Also, such monomeric Fc chain variants are preferably such that they are still capable of binding to the complement or the relevant Fc receptor(s) (depending on the Fc portion from which they are derived), and/or such that they still have some or all of the effector functions of the Fc portion from which they are derived (or at a reduced level still suitable for the intended use). Alternatively, in such a polypeptide chain of the invention, the monomeric Fc chain may be used to confer increased half-life upon the polypeptide chain, in which case the monomeric Fc chain may also have no or essentially no effector functions.

Bivalent/multivalent, bispecific/multispecific or biparatopic/multiparatopic polypeptides of the invention may also be linked to Fc portions, in order to provide polypeptide constructs of the type that is described in U.S. provisional application 61/005,331 entitled "Immunoglobulin constructs" filed on Dec. 4, 2007 (see also the International patent application by Ablynx N.V. entitled "Immunoglobulin constructs" with the same filing date as the present application) which is incorporated herein by reference.

The invention, for example also relates to compounds or constructs that comprises an Fc portion that is linked, optionally via a suitable linker or hinge region, to a pair of first amino acid sequences of the invention (preferably Nanobodies of the invention), which are linked, optionally via a suitable linker, to a pair of second amino acid sequences of the invention (preferably Nanobodies of the invention), wherein:

both of the first amino acid sequences of the invention (preferably Nanobodies of the invention) are directed against a first epitope, antigenic determinant, part, domain or subunit on HER2; and both of the amino acid sequences of the invention (preferably Nanobodies of the invention) are directed against a second epitope, antigenic determinant, part, domain or subunit on HER2 which is the same or different from said first epitope, antigenic determinant, part, domain or subunit.

Such compounds or constructs of the invention may, for example be directed against the Herceptin® binding site on HER-2 (and in particular against domain IV of HER2, and more in particular against the C-terminus of domain IV of HER2) and/or are compounds or constructs that are capable of competing with Herceptin® for binding to HER-2; they may be directed against the Omnitarg® binding site on HER-2 (and in particular against domain II of HER2, and more in particular against the middle of domain II of HER2) and/or are compounds or constructs that are capable of competing with Omnitarg® for binding to HER-2; or they may be directed against the Herceptin® binding site on HER-2 (and in particular against domain IV of HER2, and more in particular against the C-terminus of domain IV of HER2) and/or are compounds or constructs that are capable of competing with Herceptin® for binding to HER-2 and simultaneously be directed against the Omnitarg® binding site on HER-2 (and in particular against domain II of HER2, and more in particular against the middle of domain II of HER2) and/or are compounds or constructs that are capable of competing with Omnitarg® for binding to HER-2.

The further amino acid sequences may also form a signal sequence or leader sequence that directs secretion of the Nanobody or the polypeptide of the invention from a host cell upon synthesis (for example to provide a pre-, pro- or preproform of the polypeptide of the invention, depending on the host cell used to express the polypeptide of the invention).

The further amino acid sequence may also form a sequence or signal that allows the Nanobody or polypeptide of the invention to be directed towards and/or to penetrate or enter into specific organs, tissues, cells, or parts or compartments of cells, and/or that allows the Nanobody or polypeptide of the invention to penetrate or cross a biological barrier such as a cell membrane, a cell layer such as a layer of epithelial cells, a tumor including solid tumors, or the blood-brain-barrier. Suitable examples of such amino acid sequences will be clear to the skilled person, and for example include, but are not limited to, the "Peptrans" vectors mentioned above, the sequences described by Cardinale et al. and the amino acid sequences and antibody fragments known per se that can be used to express or produce the Nanobodies and polypeptides of the invention as so-called "intrabodies", for example as described in WO 94/02610, WO 95/22618, U.S. Pat. No. 7,004,940, WO 03/014960, WO 99/07414; WO 05/01690; EP 1 512 696; and in Cattaneo, A. & Biocca, S. (1997) Intracellular Antibodies: Development and Applications. Landes and Springer-Verlag; and in Kontermann, Methods 34, (2004), 163-170, and the further references described therein.

For some applications, in particular for those applications in which it is intended to kill a cell that expresses the target against which the Nanobodies of the invention are directed (e.g. in the treatment of cancer), or to reduce or slow the growth and/or proliferation of such a cell, the Nanobodies of the invention may also be linked to a (cyto)toxic protein or polypeptide. Examples of such toxic proteins and polypeptides which can be linked to a Nanobody of the invention to provide—for example—a cytotoxic polypeptide of the invention will be clear to the skilled person and can for example be found in the prior art cited above and/or in the further description herein. One example is the so-called ADEPT™ technology described in WO 03/055527.

According to one preferred, but non-limiting aspect, said one or more further amino acid sequences comprise at least one further Nanobody, so as to provide a polypeptide of the invention that comprises at least two, such as three, four, five or more Nanobodies, in which said Nanobodies may optionally be linked via one or more linker sequences (as defined herein). Polypeptides of the invention that comprise two or more Nanobodies, of which at least one is a Nanobody of the invention, will also be referred to herein as "multivalent" polypeptides of the invention, and the Nanobodies present in such polypeptides will also be referred to herein as being in a "multivalent format". For example a "bivalent" polypeptide of the invention comprises two Nanobodies, optionally linked via a linker sequence, whereas a "trivalent" polypeptide of the invention comprises three Nanobodies, optionally linked via two linker sequences; etc.; in which at least one of the Nanobodies present in the polypeptide, and up to all of the Nanobodies present in the polypeptide, is/are a Nanobody of the invention.

In a multivalent polypeptide of the invention, the two or more Nanobodies may be the same or different, and may be directed against the same antigen or antigenic determinant (for example against the same part(s) or epitope(s) or against different parts or epitopes) or may alternatively be directed against different antigens or antigenic determinants; or any suitable combination thereof. For example, a bivalent polypeptide of the invention may comprise (a) two identical Nanobodies; (b) a first Nanobody directed against a first antigenic determinant of a protein or antigen and a second Nanobody directed against the same antigenic determinant of said protein or antigen which is different from the first Nanobody; (c) a first Nanobody directed against a first antigenic determinant of a protein or antigen and a second Nanobody directed against another antigenic determinant of said protein or antigen; or (d) a first Nanobody directed against a first protein or antigen and a second Nanobody directed against a second protein or antigen (i.e. different from said first antigen). Similarly, a trivalent polypeptide of the invention may, for example and without being limited thereto. comprise (a) three identical Nanobodies; (b) two identical Nanobody against a first antigenic determinant of an antigen and a third Nanobody directed against a different antigenic determinant of the same antigen; (c) two identical Nanobody against a first antigenic determinant of an antigen and a third Nanobody directed against a second antigen different from said first antigen; (d) a first Nanobody directed against a first antigenic determinant of an antigen, a second Nanobody directed against a second antigenic determinant of said antigen and a third Nanobody directed against a third antigenic determinant of the same antigen; (e) a first Nanobody directed against a first antigenic determinant of a first antigen, a second Nanobody directed against a second antigenic determinant of said first antigen and a third Nanobody directed against a second antigen different from said first antigen; or (f) a first Nanobody directed against a first antigen, a second Nanobody directed against a second antigen different from said first antigen, and a third Nanobody directed against a third antigen different from said first and second antigen.

Polypeptides of the invention that contain at least two Nanobodies, in which at least one Nanobody is directed against a first antigenic determinant on HER2 and at least one Nanobody is directed against a second antigenic determinant on HER2 will also be referred to as "multiparatopic" polypeptides of the invention, and the Nanobodies present in such polypeptides will also be referred to herein as being in a "multiparatopic format". Thus, for example, a "biparatopic" polypeptide of the invention is a polypeptide that comprises at least one Nanobody directed against a first antigenic determinant on HER2 and at least one further Nanobody directed against a second antigenic determinant on HER2, whereas a "triparatopic" polypeptide of the invention is a polypeptide that comprises at least one Nanobody directed against a first antigenic determinant on HER2, at least one further Nanobody directed against a second antigenic determinant on HER2 and at least one further Nanobody directed against a third antigenic determinant on HER2; etc.

Accordingly, in its simplest form, a biparatopic polypeptide of the invention is a bivalent polypeptide of the invention (as defined herein), comprising a first Nanobody directed against a first antigenic determinant on HER2, and a second Nanobody directed against a second antigenic determinant on HER2, in which said first and second Nanobody may optionally be linked via a linker sequence (as defined herein); whereas a triparatopic polypeptide of the invention in its simplest form is a trivalent polypeptide of the invention (as defined herein), comprising a first Nanobody directed against a first antigenic determinant on HER2, a second. Nanobody directed against a second antigenic determinant on HER2 and a third Nanobody directed against a third antigenic determinant on HER2, in which said first, second and third Nanobody may optionally be linked via one or more, and in particular one and more, in particular two, linker sequences.

However, as will be clear from the description hereinabove, the invention is not limited thereto, in the sense that a multiparatopic polypeptide of the invention may comprise at least one Nanobody against a first antigenic determinant on HER2, and any number of Nanobodies directed against one or more other antigenic determinants on HER2.

Polypeptides of the invention that contain at least two Nanobodies, in which at least one Nanobody is directed against a first antigen (i.e. against HER2) and at least one Nanobody is directed against a second antigen (i.e. different from HER2), will also be referred to as "multispecific" polypeptides of the invention, and the Nanobodies present in such polypeptides will also be referred to herein as being in a "multispecific format". Thus, for example, a "bispecific" polypeptide of the invention is a polypeptide that comprises at least one Nanobody directed against a first antigen (i.e. HER2) and at least one further Nanobody directed against a second antigen (i.e. different from HER2), whereas a "trispecific" polypeptide of the invention is a polypeptide that comprises at least one Nanobody directed against a first antigen (i.e. HER2), at least one further Nanobody directed against a second antigen (i.e. different from HER2) and at least one further Nanobody directed against a third antigen (i.e. different from both HER2, and the second antigen); etc.

Accordingly, in its simplest form, a bispecific polypeptide of the invention is a bivalent polypeptide of the invention (as defined herein), comprising a first Nanobody directed against HER2, and a second Nanobody directed against a second antigen, in which said first and second Nanobody may optionally be linked via a linker sequence (as defined herein); whereas a trispecific polypeptide of the invention in its simplest form is a trivalent polypeptide of the invention (as defined herein), comprising a first Nanobody directed against HER2, a second Nanobody directed against a second antigen and a third Nanobody directed against a third antigen, in which said first, second and third Nanobody may optionally be linked via one or more, and in particular one and more, in particular two, linker sequences.

However, as will be clear from the description hereinabove, the invention is not limited thereto, in the sense that a multispecific polypeptide of the invention may comprise at least one Nanobody against HER2, and any number of Nanobodies directed against one or more antigens different from HER2.

Furthermore, although it is encompassed within the scope of the invention that the specific order or arrangement of the various Nanobodies in the polypeptides of the invention may have some influence on the properties of the final polypeptide of the invention (including but not limited to the affinity, specificity or avidity for HER2, or against the one or more other antigens), said order or arrangement is usually not critical and may be suitably chosen by the skilled person, optionally after some limited routine experiments based on the disclosure herein. Thus, when reference is made to a specific multivalent or multispecific polypeptide of the invention, it should be noted that this encompasses any order or arrangements of the relevant Nanobodies, unless explicitly indicated otherwise.

Finally, it is also within the scope of the invention that the polypeptides of the invention contain two or more Nanobodies and one or more further amino acid sequences (as mentioned herein).

For multivalent and multispecific polypeptides containing one or more $V_{HH}$ domains and their preparation, reference is also made to Conrath et al., J. Biol. Chem., Vol. 276, 10. 7346-7350, 2001; Muyldermans, Reviews in Molecular Biotechnology 74 (2001), 277-302; as well as to for example WO 96/34103 and WO 99/23221. Some other examples of some specific multispecific and/or multivalent polypeptide of the invention can be found in the applications by Ablynx N.V. referred to herein.

One preferred, but non-limiting example of a multispecific polypeptide of the invention comprises at least one Nanobody of the invention and at least one Nanobody that provides for an increased half-life. Such Nanobodies may for example be Nanobodies that are directed against a serum protein, and in particular a human serum protein, such as human serum albumin, thyroxine-binding protein, (human) transferrin, fibrinogen, an immunoglobulin such as IgG, IgE or IgM, or against one of the serum proteins listed in WO 04/003019. Of these, Nanobodies that can bind to serum albumin (and in particular human serum albumin) or to IgG (and in particular human IgG, see for example Nanobody VH-1 described in the review by Muyldermans, supra) are particularly preferred (although for example, for experiments in mice or primates, Nanobodies against or cross-reactive with mouse serum albumin (MSA) or serum albumin from said primate, respectively, can be used. However, for pharmaceutical use, Nanobodies against human serum albumin or human IgG will usually be preferred). Nanobodies that provide for increased half-life and that can be used in the polypeptides of the invention include the Nanobodies directed against serum albumin that are described in WO 04/041865, in WO 06/122787 and in the further patent applications by Ablynx N.V., such as those mentioned above.

For example, the some preferred Nanobodies that provide for increased half-life for use in the present invention include Nanobodies that can bind to amino acid residues on (human) serum albumin that are not involved in binding of serum albumin to FcRn (see for example WO 06/0122787); Nanobodies that are capable of binding to amino acid residues on serum albumin that do not form part of domain III of serum albumin (see for example WO 06/0122787); Nanobodies that have or can provide an increased half-life (see for example WO 08/028,977 by Ablynx N.V.); Nanobodies against human serum albumin that are cross-reactive with serum albumin from at least one species of mammal, and in particular with at least one species of primate (such as, without limitation, monkeys from the genus *Macaca* (such as, and in particular, cynomologus monkeys (*Macaca fascicularis*) and/or rhesus monkeys (*Macaca mulatta*)) and baboon (*Papio ursinus*)) (see for example WO 08/028,977 by Ablynx N.V.); Nanobodies that can bind to serum albumin in a pH independent manner (see for example WO 08/043,821 by Ablynx N.V.) and/or Nanobodies that are conditional binders (see for example WO 08/043,822 by Ablynx N.V.).

Some particularly preferred Nanobodies that provide for increased half-life and that can be used in the polypeptides of the invention include the Nanobodies ALB-1 to ALB-10 disclosed in WO 06/122787 (see Tables II and III) of which ALB-8 (SEQ ID NO: 62 in WO 06/122787) is particularly preferred.

Some preferred, but non-limiting examples of polypeptides of the invention that comprise at least one Nanobody of the invention and at least one Nanobody that provides for increased half-life are given in SEQ ID NOs: 2331-2335.

According to a specific, but non-limiting aspect of the invention, the polypeptides of the invention contain, besides the one or more Nanobodies of the invention, at least one Nanobody against human serum albumin.

Generally, any polypeptides of the invention with increased half-life that contain one or more Nanobodies of the invention, and any derivatives of Nanobodies of the invention or of such polypeptides that have an increased half-life, preferably have a half-life that is at least 1.5 times, preferably at least 2 times, such as at least 5 times, for example at least 10 times or more than 20 times, greater than the half-life of the corresponding Nanobody of the invention per se. For example, such a derivative or polypeptides with increased half-life may have a half-life that is increased with more than 1 hours, preferably more than 2 hours, more preferably more than 6 hours, such as more than 12 hours, or even more than 24, 48 or 72 hours, compared to the corresponding Nanobody of the invention per se.

In a preferred, but non-limiting aspect of the invention, such derivatives or polypeptides may exhibit a serum half-life in human of at least about 12 hours, preferably at least 24 hours, more preferably at least 48 hours, even more preferably at least 72 hours or more. For example, such derivatives or polypeptides may have a half-life of at least 5 days (such as about 5 to 10 days), preferably at least 9 days (such as about 9 to 14 days), more preferably at least about 10 days (such as about 10 to 15 days), or at least about 11 days (such as about 11 to 16 days), more preferably at least about 12 days (such as about 12 to 18 days or more), or more than 14 days (such as about 14 to 19 days).

According to one aspect of the invention the polypeptides are capable of binding to one or more molecules which can increase the half-life of the polypeptide in vivo.

The polypeptides of the invention are stabilised in vivo and their half-life increased by binding to molecules which resist degradation and/or clearance or sequestration. Typically, such molecules are naturally occurring proteins which themselves have a long half-life in vivo.

Another preferred, but non-limiting example of a multispecific polypeptide of the invention comprises at least one Nanobody of the invention and at least one Nanobody that directs the polypeptide of the invention towards, and/or that allows the polypeptide of the invention to penetrate or to enter into specific organs, tissues, cells, or parts or compartments of cells, and/or that allows the Nanobody to penetrate or cross a biological barrier such as a cell membrane, a cell layer such as a layer of epithelial cells, a tumor including solid tumors, or the blood-brain-barrier. Examples of such Nanobodies include Nanobodies that are directed towards specific cell-surface proteins, markers or epitopes of the desired organ, tissue or cell (for example cell-surface markers associated with tumor cells), and the single-domain brain targeting antibody fragments described in WO 02/057445 and WO 06/040153, of which FC44 (SEQ ID NO: 189 of WO 06/040153) and FC5 (SEQ ID NO: 190 of WO 06/040154) are preferred examples.

In the polypeptides of the invention, the one or more Nanobodies and the one or more polypeptides may be directly linked to each other (as for example described in WO 99/23221) and/or may be linked to each other via one or more suitable spacers or linkers, or any combination thereof.

Suitable spacers or linkers for use in multivalent, multiparatopic and multispecific polypeptides will be clear to the skilled person, and may generally be any linker or spacer used in the art to link amino acid sequences. Preferably, said linker or spacer is suitable for use in constructing proteins or polypeptides that are intended for pharmaceutical use.

Some particularly preferred spacers include the spacers and linkers that are used in the art to link antibody fragments or antibody domains. These include the linkers mentioned in the general background art cited above, as well as for example linkers that are used in the art to construct diabodies or ScFv fragments (in this respect, however, its should be noted that, whereas in diabodies and in ScFv fragments, the linker sequence used should have a length, a degree of flexibility and other properties that allow the pertinent $V_H$ and $V_L$ domains to come together to form the complete antigen-binding site, there is no particular limitation on the length or the flexibility of the linker used in the polypeptide of the invention, since each Nanobody by itself forms a complete antigen-binding site).

For example, a linker may be a suitable amino acid sequence, and in particular amino acid sequences of between 1 and 75, preferably between 1 and 60, more preferably between 1 and 50, even more preferably between 1 and 30, such as between 1 and 10 amino acid residues. Some preferred examples of such amino acid sequences include gly-ser linkers, for example of the type $(gly_xser_y)_z$, such as (for example $(gly_4ser)_3$ or $(gly_3ser_2)_3$, as described in WO 99/42077 and the GS30, GS15, GS9 and GS7 linkers described in the applications by Ablynx mentioned herein (see for example WO 06/040153 and WO 06/122825), as well as hinge-like regions, such as the hinge regions of naturally occurring heavy chain antibodies or similar sequences (such as described in WO 94/04678).

Some other particularly preferred linkers are poly-alanine (such as AAA), as well as the linkers GS35, GS30 (SEQ ID NO: 85 in WO 06/122825) and GS9 (SEQ ID NO: 84 in WO 06/122825).

Other suitable linkers generally comprise organic compounds or polymers, in particular those suitable for use in proteins for pharmaceutical use. For instance, polyethyleneglycol) moieties have been used to link antibody domains, see for example WO 04/081026.

It is encompassed within the scope of the invention that the length, the degree of flexibility and/or other properties of the linker(s) used (although not critical, as it usually is for linkers used in ScFv fragments) may have some influence on the properties of the final polypeptide of the invention, including but not limited to the affinity, specificity or avidity for HER2, or for one or more of the other antigens. Based on the disclosure herein, the skilled person will be able to determine the optimal linker(s) for use in a specific polypeptide of the invention, optionally after some limited routine experiments.

For example, in multivalent polypeptides of the invention that comprise Nanobodies directed against a multimeric antigen (such as a multimeric receptor or other protein), the length and flexibility of the linker are preferably such that it allows each Nanobody of the invention present in the polypeptide to bind to the antigenic determinant on each of the subunits of the multimer.

Similarly, in a multiparatopic polypeptide of the invention that comprises Nanobodies directed against two or more different antigenic determinants on the same antigen (for example against different epitopes of an antigen and/or against different subunits of a multimeric receptor or protein), the length and flexibility of the linker are preferably such that, when the multiparatopic polypeptide binds to HER-2, at least two and preferably all of the Nanobodies that are present in the multiparatopic polypeptide can (simultaneously) bind to each of their intended antigenic determinants, epitopes, parts or domains, most preferably so as to allow binding with increased avidity and also intramolecular binding and/or recognition. Again, based on the disclosure herein, the skilled person will be able to determine the optimal linker(s) for use in a specific polypeptide of the invention, optionally after some limited routine experiments.

For example, as further described herein, some of the most preferred multiparatopic polypeptides of the invention comprise (i) at least one amino acid sequence of the invention (and in particular at least one Nanobody) that is directed against the Omnitarg binding site on HER2 (and in particular against domain II of HER2, and more in particular against the middle of domain II of HER2) and/or that is capable of competing with Omnitarg for binding to HER-2; and at least one amino acid sequence of the invention (and in particular at least one Nanobody) that is directed against the Herceptin® binding site on HER2 (and in particular against domain IV of HER2, and more in particular against the C-terminus of domain IV of HER2) and/or that is capable of competing with Herceptin® for binding to HER-2. In such a preferred multiparatopic polypeptide of the invention, the linker is most preferably such that the multiparatopic polypeptide of the invention is capable of (simultaneously) binding to both the Omnitarg binding site on HER2 (and in particular against domain II of HER2, and more in particular against the middle of domain of HER2) as well as the Herceptin® binding site on HER2 (and in particular against domain IV of HER2, and more in particular against the C-terminus of domain IV of HER2), again most preferably so as to allow binding with increased avidity and also intramolecular binding and/or recognition. Such multiparatopic polypeptides of the invention with such a linker form a particularly preferred aspect of the invention, and examples of such a linker are given in the Examples below. For example, when such a linker is a Gly-Ser linker (for example, a Gly-Ser linker as described in the Examples), it preferably has a length of at least 15 amino acid residues, such as at least 20 or at least 30 amino acid residues. The maximum length is not especially critical, but for practical considerations (such as ease of cloning and expression) the linker is preferably no longer than 75 amino acid residues, more preferably less than 50 amino acid residues. For example, Gly-Ser linkers (such as the Gly-Ser linkers as described in the Examples) of between 20 and 40 amino acid residues, such as about 25, 30 or 35 amino acid residues, may be particularly suited. Based on the disclosure herein, the skilled person will be able to determine other suitable linkers, it being understood that the optimal length of each linker may also depend on the amino acid composition of the linker that is envisaged for use.

Optimal linker lengths in biparatopic, triparatopic or multiparatopic polypeptides of the invention can, for example, be designed in silico with any method for protein design known in the art or disclosed herein (see, e.g. the Example section). Optimal linker lengths, far example obtained by in silico design, can further be verified experimentally by binding and competition assays as will be known to the skilled person and/or described herein (see e.g. the example section). Optimal linker lengths in biparatopic, triparatopic or multiparatopic polypeptides may also be determined using the screening method for determining optimal linker length as described herein.

The choice of linker length in biparatopic, triparatopic or multiparatopic polypeptides of the invention can also be such that only a limited epitope space on the antigen is covered. Linker length restriction can, for example, help to avoid targeting epitopes which should not be neutralized (e.g. those essential for a function of the antigen) or to target regions relatively adjacent to a first 'guiding' Nanobody.

The choice of the format (N- or C-terminal position of the different Nanobodies) of the biparatopic, triparatopic or multiparatopic polypeptides of the invention and linker length can also be used to obtain molecules that bind avidly to the target antigen (via two, or more, binding sites), yet are purposely not agonistic. By optimising the format and linker length and composition, the binding sites can be positioned in such way that simultaneous binding of two or more Nanobodies to the same target antigen (i.e. intramolecular binding) will be highly favoured compared to binding to separate antigens in proximity of one another (intermolecular binding, such as e.g. on a cell surface). This could, for example, reduce the chance on agonism (which might not be desired in a good therapeutic compound). Screening and/or selection methods and assays are known to the skilled person and/or described herein that allow for the isolation of avidly binding domains positioned in relation to one another and to the antigen of interest in such way as to have an antagonistic function only.

In another aspect of the invention, biparatopic, triparatopic or multiparatopic polypeptides of the invention can also be selected to be purposely agonistic. For example, a combination of two identical or two different Nanobodies that bind to the Herceptin®-binding site and are genetically fused to one another can be agonistic (e.g. 2D3-2D3 or 2D3 fused to other Herceptin®-competing Nanobodies). The current invention also provides a way to select for such agonistic biparatopic, triparatopic or multiparatopic polypeptides of the invention using appropriate screening and/or selection procedures of members of multiparatopic libraries. Agonists could, for example, be desired and/or interesting for triggering certain receptors.

It is also within the scope of the invention that the linker(s) used confer one or more other favourable properties or functionality to the polypeptides of the invention, and/or provide one or more sites for the formation of derivatives and/or for the attachment of functional groups (e.g. as described herein for the derivatives of the Nanobodies of the invention). For example, linkers containing one or more charged amino acid residues (see Table A-2 above) can provide improved hydrophilic properties, whereas linkers that form or contain small epitopes or tags can be used for the purposes of detection, identification and/or purification. Again, based on the disclosure herein, the skilled person will be able to determine the optimal linkers for use in a specific polypeptide of the invention, optionally after some limited routine experiments.

Finally, when two or more linkers are used in the polypeptides of the invention, these linkers may be the same or different. Again, based on the disclosure herein, the skilled person will be able to determine the optimal linkers for use in a specific polypeptide of the invention, optionally after some limited routine experiments.

Usually, for easy of expression and production, a polypeptide of the invention will be a linear polypeptide. However, the invention in its broadest sense is not limited thereto. For example, when a polypeptide of the invention comprises three of more Nanobodies, it is possible to link them by use of a linker with three or more "arms", which each "arm" being linked to a Nanobody, so as to provide a "star-shaped" construct. It is also possible, although usually less preferred, to use circular constructs.

The invention also comprises derivatives of the polypeptides of the invention, which may be essentially analogous to the derivatives of the Nanobodies of the invention, i.e. as described herein.

The invention also comprises proteins or polypeptides that "essentially consist" of a polypeptide of the invention (in which the wording "essentially consist of" has essentially the same meaning as indicated hereinabove).

According to one aspect of the invention, the polypeptide of the invention is in essentially isolated from, as defined herein.

The amino acid sequences, Nanobodies, polypeptides and nucleic acids of the invention can be prepared in a manner known per se, as will be clear to the skilled person from the further description herein. For example, the Nanobodies and polypeptides of the invention can be prepared in any manner known per se for the preparation of antibodies and in particular for the preparation of antibody fragments (including but not limited to (single) domain antibodies and ScFv fragments). Some preferred, but non-limiting methods for preparing the amino acid sequences, Nanobodies, polypeptides and nucleic acids include the methods and techniques described herein.

As will be clear to the skilled person, one particularly useful method for preparing an amino acid sequence, Nanobody and/or a polypeptide of the invention generally comprises the steps of:

i) the expression, in a suitable host cell or host organism (also referred to herein as a "host of the invention") or in another suitable expression system of a nucleic acid that encodes said amino acid sequence, Nanobody or polypeptide of the invention (also referred to herein as a "nucleic acid of the invention"), optionally followed by:

ii) isolating and/or purifying the amino acid sequence, Nanobody or polypeptide of the invention thus obtained.

In particular, such a method may comprise the steps of:

i) cultivating and/or maintaining a host of the invention under conditions that are such that said host of the invention expresses and/or produces at least one amino acid sequence, Nanobody and/or polypeptide of the invention; optionally followed by:

ii) isolating and/or purifying the amino acid sequence, Nanobody or polypeptide of the invention thus obtained.

A nucleic acid of the invention can be in the form of single or double stranded DNA or RNA, and is preferably in the form of double stranded DNA. For example, the nucleotide sequences of the invention may be genomic DNA, cDNA or synthetic DNA (such as DNA with a codon usage that has been specifically adapted for expression in the intended host cell or host organism).

According to one aspect of the invention, the nucleic acid of the invention is in essentially isolated from, as defined herein.

The nucleic acid of the invention may also be in the form of, be present in and/or be part of a vector, such as for example a plasmid, cosmid or YAC, which again may be in essentially isolated form.

The nucleic acids of the invention can be prepared or obtained in a manner known per se, based on the information on the amino acid sequences for the polypeptides of the invention given herein, and/or can be isolated from a suitable natural source. To provide analogs, nucleotide sequences encoding naturally occurring $V_{HH}$ domains can for example be subjected to site-directed mutagenesis, so at to provide a nucleic acid of the invention encoding said analog. Also, as will be clear to the skilled person, to prepare a nucleic acid of the invention, also several nucleotide sequences, such as at least one nucleotide sequence encoding a Nanobody and for example nucleic acids encoding one or more linkers can be linked together in a suitable manner.

Techniques for generating the nucleic acids of the invention will be clear to the skilled person and may for instance include, but are not limited to, automated DNA synthesis; site-directed mutagenesis; combining two or more naturally occurring and/or synthetic sequences (or two or more parts thereof), introduction of mutations that lead to the expression of a truncated expression product; introduction of one or more restriction sites (e.g. to create cassettes and/or regions that may easily be digested and/or ligated using suitable restriction enzymes), and/or the introduction of mutations by means of a PCR reaction using one or more "mismatched" primers, using for example a sequence of a naturally occurring form of HER2 as a template. These and other techniques will be clear to the skilled person, and reference is again made to the standard handbooks, such as Sambrook et al. and Ausubel et al., mentioned above, as well as the Examples below.

The nucleic acid of the invention may also be in the form of, be present in and/or be part of a genetic construct, as will be clear to the person skilled in the art. Such genetic constructs generally comprise at least one nucleic acid of the invention that is optionally linked to one or more elements of genetic constructs known per se, such as for example one or more suitable regulatory elements (such as a suitable promoter(s), enhancer(s), terminator(s), etc.) and the further elements of genetic constructs referred to herein. Such genetic constructs comprising at least one nucleic acid of the invention will also be referred to herein as "genetic constructs of the invention".

The genetic constructs of the invention may be DNA or RNA, and are preferably double-stranded DNA. The genetic constructs of the invention may also be in a form suitable for transformation of the intended host cell or host organism, in a form suitable for integration into the genomic DNA of the intended host cell or in a form suitable for independent replication, maintenance and/or inheritance in the intended host organism. For instance, the genetic constructs of the invention may be in the form of a vector, such as for example a plasmid, cosmid, YAC, a viral vector or transposon. In particular, the vector may be an expression vector, i.e. a vector that can provide for expression in vitro and/or in vivo (e.g. in a suitable host cell, host organism and/or expression system).

In a preferred but non-limiting aspect, a genetic construct of the invention comprises
i) at least one nucleic acid of the invention; operably connected to
ii) one or more regulatory elements, such as a promoter and optionally a suitable terminator;
and optionally also
iii) one or more further elements of genetic constructs known per se;
in which the terms "regulatory element", "promoter", "terminator" and "operably connected" have their usual meaning in the art (as further described herein); and in which said "further elements" present in the genetic constructs may for example be 3'- or 5'-UTR sequences, leader sequences, selection markers, expression markers/reporter genes, and/or elements that may facilitate or increase (the efficiency of) transformation or integration. These and other suitable elements for such genetic constructs will be clear to the skilled person, and may for instance depend upon the type of construct used, the intended host cell or host organism; the manner in which the nucleotide sequences of the invention of interest are to be expressed (e.g. via constitutive, transient or inducible expression); and/or the transformation technique to be used. For example, regulatory sequences, promoters and terminators known per se for the expression and production of antibodies and antibody fragments (including but not limited to (single) domain antibodies and ScFv fragments) may be used in an essentially analogous manner.

Preferably, in the genetic constructs of the invention, said at least one nucleic acid of the invention and said regulatory elements, and optionally said one or more further elements, are "operably linked" to each other, by which is generally meant that they are in a functional relationship with each other. For instance, a promoter is considered "operably linked" to a coding sequence if said promoter is able to initiate or otherwise control/regulate the transcription and/or the expression of a coding sequence (in which said coding sequence should be understood as being "under the control of" said promotor). Generally, when two nucleotide sequences are operably linked, they will be in the same orientation and usually also in the same reading frame. They will usually also be essentially contiguous, although this may also not be required.

Preferably, the regulatory and further elements of the genetic constructs of the invention are such that they are capable of providing their intended biological function in the intended host cell or host organism.

For instance, a promoter, enhancer or terminator should be "operable" in the intended host cell or host organism, by which is meant that (for example) said promoter should be capable of initiating or otherwise controlling/regulating the transcription and/or the expression of a nucleotide sequence—e.g. a coding sequence—to which it is operably linked (as defined herein).

Some particularly preferred promoters include, but are not limited to, promoters known per se for the expression in the host cells mentioned herein; and in particular promoters for the expression in the bacterial cells, such as those mentioned herein and/or those used in the Examples.

A selection marker should be such that it allows—i.e. under appropriate selection conditions—host cells and/or host organisms that have been (successfully) transformed with the nucleotide sequence of the invention to be distinguished from host cells/organisms that have not been (successfully) transformed. Some preferred, but non-limiting examples of such markers are genes that provide resistance against antibiotics (such as kanamycin or ampicillin), genes that provide for temperature resistance, or genes that allow the host cell or host organism to be maintained in the absence of certain factors, compounds and/or (food) components in the medium that are essential for survival of the non-transformed cells or organisms.

A leader sequence should be such that—in the intended host cell or host organism—it allows for the desired post-translational modifications and/or such that it directs the transcribed mRNA to a desired part or organelle of a cell. A leader sequence may also allow for secretion of the expression product from said cell. As such, the leader sequence may be any pro-, pre-, or prepro-sequence operable in the host cell or host organism. Leader sequences may not be required for expression in a bacterial cell. For example, leader sequences known per se for the expression and production of antibodies and antibody fragments (including but not limited to single domain antibodies and ScFv fragments) may be used in an essentially analogous manner.

An expression marker or reporter gene should be such that—in the host cell or host organism—it allows for detection of the expression of (a gene or nucleotide sequence present on) the genetic construct. An expression marker may optionally also allow for the localisation of the expressed product, e.g. in a specific part or organelle of a cell and/or in (a) specific cell(s), tissue(s), organ(s) or part(s) of a multicellular organism. Such reporter genes may also be expressed as a protein fusion with the amino acid sequence of the invention. Some preferred, but non-limiting examples include fluorescent proteins such as GFP.

Some preferred, but non-limiting examples of suitable promoters, terminator and further elements include those that can be used for the expression in the host cells mentioned herein; and in particular those that are suitable for expression in bacterial cells, such as those mentioned herein and/or those used in the Examples below. For some (further) non-limiting examples of the promoters, selection markers, leader sequences, expression markers and further elements that may be present/used in the genetic constructs of the invention—such as terminators, transcriptional and/or translational enhancers and/or integration factors—reference is made to the general handbooks such as Sambrook et al. and Ausubel et al. mentioned above, as well as to the examples that are given in WO 95/07463, WO 96/23810, WO 95/07463, WO 95/21191, WO 97/11094, WO 97/42320. WO 98/06737, WO 98/21355, U.S. Pat. No. 7,207,410, U.S. Pat. No. 5,693,492 and EP 1 085 089. Other examples will be clear to the skilled person. Reference is also made to the general background art cited above and the further references cited herein.

The genetic constructs of the invention may generally be provided by suitably linking the nucleotide sequence(s) of the invention to the one or more further elements described above, for example using the techniques described in the general handbooks such as Sambrook et al. and Ausubel et al., mentioned above.

Often, the genetic constructs of the invention will be obtained by inserting a nucleotide sequence of the invention in a suitable (expression) vector known per se. Some preferred, but non-limiting examples of suitable expression vectors are those used in the Examples below, as well as those mentioned herein.

The nucleic acids of the invention and/or the genetic constructs of the invention may be used to transform a host cell or host organism, i.e. for expression and/or production of the amino acid sequence, Nanobody or polypeptide of the invention. Suitable hosts or host cells will be clear to the skilled person, and may for example be any suitable fungal, prokaryotic or eukaryotic cell or cell line or any suitable fungal, prokaryotic or eukaryotic organism, for example:

a bacterial strain, including but not limited to gram-negative strains such as strains of *Escherichia coli*; of *Proteus*, for example of *Proteus mirabilis*; of *Pseudomonas*, for example of *Pseudomonas fluorescens*; and gram-positive strains such as strains of *Bacillus*, for example of *Bacillus subtilis* or of *Bacillus brevis*; of *Streptomyces*, for example of *Streptomyces lividans*; of *Staphylococcus*, for example of *Staphylococcus carnosus*; and of *Lactococcus*, for example of *Lactococcus lactis;* a fungal cell, including but not limited to cells from species of *Trichoderma*, for example from *Trichoderma reesei*; of *Neurospora*, for example from *Neurospora crassa*; of *Sordaria*, for example from *Sordaria macrospora*; of *Aspergillus*, for example from *Aspergillus niger* or from *Aspergillus sojae*; or from other filamentous fungi;

a yeast cell, including but not limited to cells from species of *Saccharomyces*, for example of *Saccharomyces cerevisiae*; of *Schizosaccharomyces*, for example of *Schizosaccharomyces pombe*; of *Pichia*, for example of *Pichia pastoris* or of *Pichia methanolica*; of *Hansenula*, for example of *Hansenula polymorpha*; of *Kluyveromyces*, for example of *Kluyveromyces lactis*; of *Arxula*, for example of *Arxula adeninivorans*; of *Yarrowia*, for example of *Yarrowia lipolytica;* an amphibian cell or cell line, such as *Xenopus oocytes;* an insect-derived cell or cell line, such as cells/cell lines derived from lepidoptera, including but not limited to *Spodoptera* SF9 and Sf21 cells or cells/cell lines derived from *Drosophila*, such as Schneider and Kc cells;

a plant or plant cell, for example in tobacco plants; and/or a mammalian cell or cell line, for example a cell or cell line derived from a human, a cell or a cell line from mammals including but not limited to CHO-cells, BHK-cells (for example BHK-21 cells) and human cells or cell lines such as HeLa, COS (for example COS-7) and PER.C6 cells;

as well as all other hosts or host cells known per se for the expression and production of antibodies and antibody fragments (including but not limited to (single) domain antibodies and ScFv fragments), which will be clear to the skilled person. Reference is also made to the general background art cited hereinabove, as well as to for example WO 94/29457; WO 96/34103; WO 99/42077; Frenken et al., (1998), supra; Riechmann and Muyldermans, (1999), supra; van der Linden, (2000), supra; Thomassen et al., (2002), supra; Joosten et al., (2003), supra; Joosten et al., (2005), supra; and the further references cited herein.

The amino acid sequences, Nanobodies and polypeptides of the invention can also be introduced and expressed in one or more cells, tissues or organs of a multicellular organism, for example for prophylactic and/or therapeutic purposes (e.g. as a gene therapy). For this purpose, the nucleotide sequences of the invention may be introduced into the cells or tissues in any suitable way, for example as such (e.g. using liposomes) or after they have been inserted into a suitable gene therapy vector (for example derived from retroviruses such as adenovirus, or parvoviruses such as adeno-associated virus). As will also be clear to the skilled person, such gene therapy may be performed in vivo and/or in situ in the body of a patient by administering a nucleic acid of the invention or a suitable gene therapy vector encoding the same to the patient or to specific cells or a specific tissue or organ of the patient; or suitable cells (often taken from the body of the patient to be treated, such as explanted lymphocytes, bone marrow aspirates or tissue biopsies) may be treated in vitro with a nucleotide sequence of the invention and then be suitably (re-) introduced into the body of the patient. All this can be performed using gene therapy vectors, techniques and delivery systems which are well known to the skilled person, and for example described in Culver, K. W., "Gene Therapy", 1994, p. xii, Mary Ann Liebert, Inc., Publishers, New York, N.Y.); Giordano, Nature F Medicine 2 (1996), 534-539; Schaper, Circ. Res. 79 (1996), 911-919; Anderson, Science 256 (1992), 808-813; Verma, Nature 389 (1994), 239; Isner, Lancet 348 (1996), 370-374; Muhlhauser, Circ. Res. 77 (1995), 1077-1086; Onodera, Blood 91; (1998), 30-36; Verma, Gene Ther. 5 (1998), 692-699; Nabel, Ann. N.Y. Acad. Sci.; 811 (1997), 289-292; Verzeletti, Hum. Gene Ther. 9 (1998), 2243-51; Wang, Nature Medicine 2 (1996), 714-716; WO 94/29469; WO 97/00957, U.S. Pat. No. 5,580,859; U.S. Pat. No. 5,589,546; or Schaper, Current Opinion in Biotechnology 7 (1996), 635-640. For example, in situ expression of ScFv fragments (Afanasieva et al., Gene Ther., 10, 1850-1859 (2003)) and of diabodies (Blanco et al., J. Immunol, 171, 1070-1077 (2003)) has been described in the art.

For expression of the Nanobodies in a cell, they may also be expressed as so-called "intrabodies", as for example described in WO 94/02610, WO 95/22618 and U.S. Pat. No. 7,004,940; WO 03/014960; in Cattaneo, A. & Biocca, S. (1997) Intracellular Antibodies: Development and Applications. Landes and Springer-Verlag; and in Kontermann, Methods 34, (2004), 163-170.

The amino acid sequences, Nanobodies and polypeptides of the invention can for example also be produced in the milk of transgenic mammals, for example in the milk of rabbits, cows, goats or sheep (see for example U.S. Pat. No. 6,741, 957, U.S. Pat. No. 6,304,489 and U.S. Pat. No. 6,849,992 for general techniques for introducing transgenes into mammals), in plants or parts of plants including but not limited to their leaves, flowers, fruits, seed, roots or turbers (for example in tobacco, maize, soybean or alfalfa) or in for example pupae of the silkworm *Bombix mori*.

Furthermore, the amino acid sequences, Nanobodies and polypeptides of the invention can also be expressed and/or produced in cell-free expression systems, and suitable examples of such systems will be clear to the skilled person. Some preferred, but non-limiting examples include expression in the wheat germ system; in rabbit reticulocyte lysates; or in the *E. coli* Zubay system.

As mentioned above, one of the advantages of the use of Nanobodies is that the polypeptides based thereon can be prepared through expression in a suitable bacterial system, and suitable bacterial expression systems, vectors, host cells, regulatory elements, etc., will be clear to the skilled person, for example from the references cited above. It should however be noted that the invention in its broadest sense is not limited to expression in bacterial systems.

Preferably, in the invention, an (in vivo or in vitro) expression system, such as a bacterial expression system, is used that provides the polypeptides of the invention in a form that is suitable for pharmaceutical use, and such expression systems will again be clear to the skilled person. As also will be clear to the skilled person, polypeptides of the invention suitable for pharmaceutical use can be prepared using techniques for peptide synthesis.

For production on industrial scale, preferred heterologous hosts for the (industrial) production of Nanobodies or Nanobody-containing protein therapeutics include strains of *E. coli, Pichia pastoris, S. cerevisiae* that are suitable for large scale expression/production/fermentation, and in particular for large scale pharmaceutical (i.e. GMP grade) expression/production/fermentation. Suitable examples of such strains will be clear to the skilled person. Such strains and production/expression systems are also made available by companies such as Biovitrum (Uppsala, Sweden).

Alternatively, mammalian, cell lines, in particular Chinese hamster ovary (CHO) cells, can be used for large scale expression/production/fermentation, and in particular for large scale pharmaceutical expression/production/fermentation. Again, such expression/production systems are also made available by some of the companies mentioned above.

The choice of the specific expression system would depend in part on the requirement for certain post-translational modifications, more specifically glycosylation. The production of a Nanobody-containing recombinant protein for which glycosylation is desired or required would necessitate the use of mammalian expression hosts that have the ability to glycosylate the expressed protein. In this respect, it will be clear to the skilled person that the glycosylation pattern obtained (i.e. the kind, number and position of residues attached) will depend on the cell or cell line that is used for the expression. Preferably, either a human cell or cell line is used (i.e. leading to a protein that essentially has a human glycosylation pattern) or another mammalian cell line is used that can provide a glycosylation pattern that is essentially and/or functionally the same as human glycosylation or at least mimics human glycosylation. Generally, prokaryotic hosts such as *E. coli* do not have the ability to glycosylate proteins, and the use of lower eukaryotes such as yeast usually leads to a glycosylation pattern that differs from human glycosylation. Nevertheless, it should be understood that all the foregoing host cells and expression systems can be used in the invention, depending on the desired amino acid sequence, Nanobody or polypeptide to be obtained.

Thus, according to one non-limiting aspect of the invention, the amino acid sequence, Nanobody or polypeptide of the invention is glycosylated. According to another non-limiting aspect of the invention, the amino acid sequence, Nanobody or polypeptide of the invention is non-glycosylated.

According to one preferred, but non-limiting aspect of the invention, the amino acid sequence, Nanobody or polypeptide of the invention is produced in a bacterial cell, in particular a bacterial cell suitable for large scale pharmaceutical production, such as cells of the strains mentioned above.

According to another preferred, but non-limiting aspect of the invention, the amino acid sequence, Nanobody or polypeptide of the invention is produced in a yeast cell, in particular a yeast cell suitable for large scale pharmaceutical production, such as cells of the species mentioned above.

According to yet another preferred, but non-limiting aspect of the invention, the amino acid sequence, Nanobody or polypeptide of the invention is produced in a mammalian cell, in particular in a human cell or in a cell of a human cell line, and more in particular in a human cell or in a cell of a human cell line that is suitable for large scale pharmaceutical production, such as the cell lines mentioned hereinabove.

When expression in a host cell is used to produce the amino acid sequences, Nanobodies and the polypeptides of the invention, the amino acid sequences, Nanobodies and polypeptides of the invention can be produced either intracellularly (e.g. in the cytosol, in the periplasma or in inclusion bodies) and then isolated from the host cells and optionally further purified; or can be produced extracellularly (e.g. in the medium in which the host cells are cultured) and then isolated from the culture medium and optionally further purified. When eukaryotic host cells are used, extracellular production is usually preferred since this considerably facilitates the further isolation and downstream processing of the Nanobodies and proteins obtained. Bacterial cells such as the strains of *E. coli* mentioned above normally do not secrete proteins extracellularly, except for a few classes of proteins such as toxins and hemolysin, and secretory production in *E. coli* refers to the translocation of proteins across the inner membrane to the periplasmic space. Periplasmic production provides several advantages over cytosolic production. For example, the N-terminal amino acid sequence of the secreted product can be identical to the natural gene product after cleavage of the secretion signal sequence by a specific signal peptidase. Also, there appears to be much less protease activity in the periplasm than in the cytoplasm. In addition, protein purification is simpler due to fewer contaminating proteins in the periplasm. Another advantage is that correct disulfide bonds may form because the periplasm provides a more oxidative environment than the cytoplasm. Proteins overexpressed in *E. coli* are often found in insoluble aggregates, so-called inclusion bodies. These inclusion bodies may be located in the cytosol or in the periplasm; the recovery of biologically active proteins from these inclusion bodies requires a denaturation/refolding process. Many recombinant proteins, including therapeutic proteins, are recovered from inclusion bodies. Alternatively, as will be clear to the skilled person, recombinant strains of bacteria that have been genetically modified so as to secrete a desired protein, and in particular an amino acid sequence, Nanobody or a polypeptide of the invention, can be used.

Thus, according to one non-limiting aspect of the invention, the amino acid sequence, Nanobody or polypeptide of the invention is an amino acid sequence, Nanobody or polypeptide that has been produced intracellularly and that has been isolated from the host cell, and in particular from a bacterial cell or from an inclusion body in a bacterial cell. According to another non-limiting aspect of the invention, the amino acid sequence, Nanobody or polypeptide of the invention is an amino acid sequence, Nanobody or polypeptide that has been produced extracellularly, and that has been isolated from the medium in which the host cell is cultivated.

Some preferred, but non-limiting promoters for use with these host cells include,
for expression in *E. coli*: lac promoter (and derivatives thereof such as the lacUV5 promoter); arabinose promoter; left-(PL) and rightward (PR) promoter of phage lambda; promoter of the trp operon; hybrid lac/trp promoters (tac and trc); T7-promoter (more specifically that of T7-phage gene 10) and other T-phage promoters; promoter of the Tn10 tetracycline resistance gene; engineered variants of the above promoters that include one or more copies of an extraneous regulatory operator sequence; for expression in *S. cerevisiae*: constitutive: ADH1 (alcohol dehydrogenase 1), ENO (enolase), CYC1 (cytochrome c iso-1), GAPDH (glyceraldehydes-3-phosphate dehydrogenase), PGK1 (phosphoglycerate kinase), PYK1 (pyruvate kinase); regulated: GAL1,10,7 (galactose metabolic enzymes), ADH2 (alcohol dehydrogenase 2), PHO5 (acid phosphatase), CUP 1 (copper metallothionein); heterologous: CaMV (cauliflower mosaic virus $^{35}$S promoter);
for expression in *Pichia pastoris*: the AOX1 promoter (alcohol oxidase I);
for expression in mammalian cells: human cytomegalovirus (hCMV) immediate early enhancer/promoter; human cytomegalovirus (hCMV) immediate early promoter variant that contains two tetracycline operator sequences such that the promoter can be regulated by the Tet repressor; Herpes Simplex Virus thymidine kinase (TK) promoter; Rous Sarcoma Virus long terminal repeat (RSV LTR) enhancer/promoter; elongation factor 1α (hEF-1α) promoter from human, chimpanzee, mouse or rat; the SV40 early promoter; HIV-1 long terminal repeat promoter; β-actin promoter;

Some preferred, but non-limiting vectors for use with these host cells include:
vectors for expression in mammalian cells: pMAMneo (Clontech), pcDNA3 (Invitrogen), pMC1neo (Stratagene), pSGS (Stratagene), EBO-pSV2-neo (ATCC 37593), pBPV-1 (8-2) (ATCC 37110), pdBPV-MMTneo (342-12) (ATCC 37224), pRSVgpt (ATCC37199), pRSVneo (ATCC37198), pSV2-dhfr (ATCC 37146), pUC-Tag (ATCC 37460) and 1ZD35 (ATCC 37565), as well as viral-based expression systems, such as those based on adenovirus;
vectors for expression in bacterial cells: pET vectors (Novagen) and pQE vectors (Qiagen);
vectors for expression in yeast or other fungal cells: pYES2 (Invitrogen) and *Pichia* expression vectors (Invitrogen);
vectors for expression in insect cells: pBlueBacII (Invitrogen) and other baculovirus vectors
vectors for expression in plants or plant cells: for example vectors based on cauliflower mosaic virus or tobacco mosaic virus, suitable strains of *Agrobacterium*, or Ti-plasmid based vectors.

Some preferred, but non-limiting secretory sequences for use with these host cells include:
for use in bacterial cells such as *E. coli*: PelB, Bla, OmpA, OmpC, OmpF, OmpT, StII, PhoA, PhoE, MalE, Lpp, LamB, and the like; TAT signal peptide, hemolysin C-terminal secretion signal;
for use in yeast: α-mating factor prepro-sequence, phosphatase (pho1), invertase (Suc), etc.;
for use in mammalian cells: indigenous signal in case the target protein is of eukaryotic origin; murine Ig κ-chain V-J2-C signal peptide; etc.

Suitable techniques for transforming a host or host cell of the invention will be clear to the skilled person and may depend on the intended host cell/host organism and the genetic construct to be used. Reference is again made to the handbooks and patent applications mentioned above.

After transformation, a step for detecting and selecting those host cells or host organisms that have been successfully transformed with the nucleotide sequence/genetic construct of the invention may be performed. This may for instance be a selection step based on a selectable marker present in the genetic construct of the invention or a step involving the detection of the amino acid sequence of the invention, e.g. using specific antibodies.

The transformed host cell (which may be in the form or a stable cell line) or host organisms (which may be in the form of a stable mutant line or strain) form further aspects of the present invention.

Preferably, these host cells or host organisms are such that they express, or are (at least) capable of expressing (e.g. under suitable conditions), an amino acid sequence, Nanobody or polypeptide of the invention (and in case of a host organism: in at least one cell, part, tissue or organ thereof). The invention also includes further generations, progeny and/or offspring of the host cell or host organism of the invention, that may for instance be obtained by cell division or by sexual or asexual reproduction.

To produce/obtain expression of the amino acid sequences of the invention, the transformed host cell or transformed host organism may generally be kept, maintained and/or cultured under conditions such that the (desired) amino acid sequence, Nanobody or polypeptide of the invention is expressed/produced. Suitable conditions will be clear to the skilled person and will usually depend upon the host cell/host organism used, as well as on the regulatory elements that control the expression of the (relevant) nucleotide sequence of the invention. Again, reference is made to the handbooks and patent applications mentioned above in the paragraphs on the genetic constructs of the invention.

Generally, suitable conditions may include the use of a suitable medium, the presence of a suitable source of food and/or suitable nutrients, the use of a suitable temperature, and optionally the presence of a suitable inducing factor or compound (e.g. when the nucleotide sequences of the invention are under the control of an inducible promoter); all of which may be selected by the skilled person. Again, under such conditions, the amino acid sequences of the invention may be expressed in a constitutive manner, in a transient manner, or only when suitably induced.

It will also be clear to the skilled person that the amino acid sequence, Nanobody or polypeptide of the invention may (first) be generated in an immature form (as mentioned above), which may then be subjected to post-translational modification, depending on the host cell/host organism used. Also, the amino acid sequence, Nanobody or polypeptide of the invention may be glycosylated, again depending on the host cell/host organism used.

The amino acid sequence, Nanobody or polypeptide of the invention may then be isolated from the host cell/host organism and/or from the medium in which said host cell or host organism was cultivated, using protein isolation and/or purification techniques known per se, such as (preparative) chromatography and/or electrophoresis techniques, differential precipitation techniques, affinity techniques (e.g. using a specific, cleavable amino acid sequence fused with the amino acid sequence, Nanobody or polypeptide of the invention) and/or preparative immunological techniques (i.e. using antibodies against the amino acid sequence to be isolated).

Generally, for pharmaceutical use, the polypeptides of the invention may be formulated as a pharmaceutical preparation or compositions comprising at least one polypeptide of the invention and at least one pharmaceutically acceptable carrier, diluent or excipient and/or adjuvant, and optionally one or more further pharmaceutically active polypeptides and/or compounds. By means of non-limiting examples, such a formulation may be in a form suitable for oral administration, for parenteral administration (such as by intravenous, intramuscular or subcutaneous injection or intravenous infusion), for topical administration, for administration by inhalation, by a skin patch, by an implant, by a suppository, etc. Such suitable administration forms—which may be solid, semi-solid or liquid, depending on the manner of administration—as well as methods and carriers for use in the preparation thereof, will be clear to the skilled person, and are further described herein.

Thus, in a further aspect, the invention relates to a pharmaceutical composition that contains at least one amino acid of the invention, at least one Nanobody of the invention or at least one polypeptide of the invention and at least one suitable carrier, diluent or excipient (i.e. suitable for pharmaceutical use), and optionally one or more further active substances.

Generally, the amino acid sequences, Nanobodies and polypeptides of the invention can be formulated and administered in any suitable manner known per se, for which reference is for example made to the general background art cited above (and in particular to WO 04/041862, WO 04/041863, WO 04/041865, WO 04/041867 and WO 08/020,079) as well as to the standard handbooks, such as Remington's Pharmaceutical Sciences, 18$^{th}$ Ed., Mack Publishing Company, USA (1990), Remington, the Science and Practice of Pharmacy, 21th Edition, Lippincott Williams and Wilkins (2005); or the Handbook of Therapeutic Antibodies (S. Dubel, Ed.), Wiley, Weinheim, 2007 (see for example pages 252-255).

For example, the amino acid sequences, Nanobodies and polypeptides of the invention may be formulated and administered in any manner known per se for conventional antibodies and antibody fragments (including ScFv's and diabodies) and other pharmaceutically active proteins. Such formulations and methods for preparing the same will be clear to the skilled person, and for example include preparations suitable for parenteral administration (for example intravenous, intraperitoneal, subcutaneous, intramuscular, intraluminal, intra-arterial or intrathecal administration) or for topical (i.e. transdermal or intradermal) administration.

Preparations for parenteral administration may for example be sterile solutions, suspensions, dispersions or emulsions that are suitable for infusion or injection. Suitable carriers or diluents for such preparations for example include, without limitation, sterile water and aqueous buffers and solutions such as physiological phosphate-buffered saline, Ringer's solutions, dextrose solution, and Hank's solution; water oils; glycerol; ethanol; glycols such as propylene glycol or as well as mineral oils, animal oils and vegetable oils, for example peanut oil, soybean oil, as well as suitable mixtures thereof. Usually, aqueous solutions or suspensions will be preferred.

The amino acid sequences, Nanobodies and polypeptides of the invention can also be administered using gene therapy methods of delivery. See, e.g., U.S. Pat. No. 5,399,346, which is incorporated by reference in its entirety. Using a gene therapy method of delivery, primary cells transfected with the gene encoding an amino acid sequence, Nanobody or polypeptide of the invention can additionally be transfected with tissue specific promoters to target specific organs, tissue, grafts, tumors, or cells and can additionally be transfected with signal and stabilization sequences for subcellularly localized expression.

Thus, the amino acid sequences, Nanobodies and polypeptides of the invention may be systemically administered, e.g., orally, in combination with a pharmaceutically acceptable vehicle such as an inert diluent or an assimilable edible carrier. They may be enclosed in hard or soft shell gelatin capsules, may be compressed into tablets, or may be incorporated directly with the food of the patient's diet. For oral therapeutic administration, the amino acid sequences, Nanobodies and polypeptides of the invention may be combined with one or more excipients and used in the form of ingestible tablets, buccal tablets, troches, capsules, elixirs, suspensions, syrups, wafers, and the like. Such compositions and preparations should contain at least 0.1% of the amino acid sequence, Nanobody or polypeptide of the invention. Their percentage in the compositions and preparations may, of course, be varied and may conveniently be between about 2 to about 60% of the weight of a given unit dosage form. The amount of the amino acid sequence, Nanobody or polypeptide of the invention in such therapeutically useful compositions is such that an effective dosage level will be obtained.

The tablets, troches, pills, capsules, and the like may also contain the following: binders such as gum tragacanth, acacia, corn starch or gelatin; excipients such as dicalcium phosphate; a disintegrating agent such as corn starch, potato starch, alginic acid and the like; a lubricant such as magnesium stearate; and a sweetening agent such as sucrose, fructose, lactose or aspartame or a flavoring agent such as peppermint, oil of wintergreen, or cherry flavoring may be added. When the unit dosage form is a capsule, it may contain, in addition to materials of the above type, a liquid carrier, such as a vegetable oil or a polyethylene glycol. Various other materials may be present as coatings or to otherwise modify the physical form of the solid unit dosage form. For instance, tablets, pills, or capsules may be coated with gelatin, wax, shellac or sugar and the like. A syrup or elixir may contain the amino acid sequences, Nanobodies and polypeptides of the invention, sucrose or fructose as a sweetening agent, methyl and propylparabens as preservatives, a dye and flavoring such as cherry or orange flavor. Of course, any material used in preparing any unit dosage form should be pharmaceutically acceptable and substantially non-toxic in the amounts employed. In addition, the amino acid sequences, Nanobodies and polypeptides of the invention may be incorporated into sustained-release preparations and devices.

Preparations and formulations for oral administration may also be provided with an enteric coating that will allow the constructs of the invention to resist the gastric environment and pass into the intestines. More generally, preparations and formulations for oral administration may be suitably formulated for delivery into any desired part of the gastrointestinal tract. In addition, suitable suppositories may be used for delivery into the gastrointestinal tract.

The amino acid sequences, Nanobodies and polypeptides of the invention may also be administered intravenously or intraperitoneally by infusion or injection. Solutions of the amino acid sequences, Nanobodies and polypeptides of the invention or their salts can be prepared in water, optionally mixed with a nontoxic surfactant. Dispersions can also be prepared in glycerol, liquid polyethylene glycols, triacetin, and mixtures thereof and in oils. Under ordinary conditions of storage and use, these preparations contain a preservative to prevent the growth of microorganisms.

The pharmaceutical dosage forms suitable for injection or infusion can include sterile aqueous solutions or dispersions or sterile powders comprising the active ingredient which are adapted for the extemporaneous preparation of sterile injectable or infusible solutions or dispersions, optionally encapsulated in liposomes. In all eases, the ultimate dosage form must be sterile, fluid and stable under the conditions of manufacture and storage. The liquid carrier or vehicle can be a solvent or liquid dispersion medium comprising, for example, water, ethanol, a polyol (for example, glycerol, propylene glycol, liquid polyethylene glycols, and the like), vegetable oils, nontoxic glyceryl esters, and suitable mixtures thereof. The proper fluidity can be maintained, for example, by the formation of liposomes, by the maintenance of the required particle size in the case of dispersions or by the use of surfactants. The prevention of the action of microorganisms can be brought about by various antibacterial and antifungal agents, for example, parabens, chlorobutanol, phenol, sorbic acid, thimerosal, and the like. In many cases, it will be preferable to include isotonic agents, for example, sugars, buffers or sodium chloride. Prolonged absorption of the injectable compositions can be brought about by the use in the compositions of agents delaying absorption, for example, aluminum monostearate and gelatin.

Sterile injectable solutions are prepared by incorporating the amino acid sequences, Nanobodies and polypeptides of the invention in the required amount in the appropriate solvent with various of the other ingredients enumerated above, as required, followed by filter sterilization. In the case of sterile powders for the preparation of sterile injectable solutions, the preferred methods of preparation are vacuum drying and the freeze drying techniques, which yield a powder of the active ingredient plus any additional desired ingredient present in the previously sterile-filtered solutions.

For topical administration, the amino acid sequences, Nanobodies and polypeptides of the invention may be applied in pure form, i.e., when they are liquids. However, it will generally be desirable to administer them to the skin as compositions or formulations, in combination with a dermatologically acceptable carrier, which may be a solid or a liquid.

Useful solid carriers include finely divided solids such as talc, clay, microcrystalline cellulose, silica, alumina and the like. Useful liquid carriers include water, hydroxyalkyls or glycols or water-alcohol/glycol blends, in which the amino acid sequences, Nanobodies and polypeptides of the invention can be dissolved or dispersed at effective levels, optionally with the aid of non-toxic surfactants. Adjuvants such as fragrances and additional antimicrobial agents can be added to optimize the properties for a given use. The resultant liquid compositions can be applied from absorbent pads, used to impregnate bandages and other dressings, or sprayed onto the affected area using pump-type or aerosol sprayers.

Thickeners such as synthetic polymers, fatty acids, fatty acid salts and esters, fatty alcohols, modified celluloses or modified mineral materials can also be employed with liquid carriers to form spreadable pastes, gels, ointments, soaps, and the like, for application directly to the skin of the user.

Examples of useful dermatological compositions which can be used to deliver the amino acid sequences, Nanobodies and polypeptides of the invention to the skin are known to the art; for example, see Jacquet et al. (U.S. Pat. No. 4,608,392), Geria (U.S. Pat. No. 4,992,478), Smith et al. (U.S. Pat. No. 4,559,157) and Wortzman (U.S. Pat. No. 4,820,508).

Useful dosages of the amino acid sequences, Nanobodies and polypeptides of the invention can be determined by comparing their in vitro activity, and in vivo activity in animal models. Methods for the extrapolation of effective dosages in mice, and other animals, to humans are known to the art; for example, see U.S. Pat. No. 4,938,949.

Generally, the concentration of the amino acid sequences, Nanobodies and polypeptides of the invention in a liquid composition, such as a lotion, will be from about 0.1-25 wt-%, preferably from about 0.5-10 wt-%. The concentration in a semi-solid or solid composition such as a gel or a powder will be about 0.1-5 wt-%, preferably about 0.5-2.5 wt-%.

The amount of the amino acid sequences, Nanobodies and polypeptides of the invention required for use in treatment will vary not only with the particular amino acid sequence, Nanobody or polypeptide selected but also with the route of administration, the nature of the condition being treated and the age and condition of the patient and will be ultimately at the discretion of the attendant physician or clinician. Also the dosage of the amino acid sequences, Nanobodies and polypeptides of the invention varies depending on the target cell, tumor, tissue, graft, or organ.

The desired dose may conveniently be presented in a single dose or as divided doses administered at appropriate intervals, for example, as two, three, four or more sub-doses per day. The sub-dose itself may be further divided, e.g., into a number of discrete loosely spaced administrations; such as multiple inhalations from an insufflator or by application of a plurality of drops into the eye.

An administration regimen could include long-term, daily treatment. By "long-term" is meant at least two weeks and preferably, several weeks, months, or years of duration. Necessary modifications in this dosage range may be determined by one of ordinary skill in the art using only routine experimentation given the teachings herein. See Remington's Pharmaceutical Sciences (Martin, E. W., ed. 4). Mack Publishing Co., Easton, Pa. The dosage can also be adjusted by the individual physician in the event of any complication.

In another aspect, the invention relates to a method for the prevention and/or treatment of at least one cancer and/or tumor, said method comprising administering, to a subject in need thereof, a pharmaceutically active amount of an amino acid sequence of the invention, of a Nanobody of the invention, of a polypeptide of the invention, and/or of a pharmaceutical composition comprising the same.

In the context of the present invention, the term "prevention and/or treatment" not only comprises preventing and/or treating the disease, but also generally comprises preventing the onset of the disease, slowing or reversing the progress of disease, preventing or slowing the onset of one or more symptoms associated with the disease, reducing and/or alleviating one or more symptoms associated with the disease, reducing the severity and/or the duration of the disease and/or of any symptoms associated therewith and/or preventing a further increase in the severity of the disease and/or of any symptoms associated therewith, preventing, reducing or reversing any physiological damage caused by the disease, and generally any pharmacological action that is beneficial to the patient being treated.

The subject to be treated may be any warm-blooded animal, but is in particular a mammal, and more in particular a human being. As will be clear to the skilled person, the subject to be treated will in particular be a person suffering from, or at risk of, the diseases and disorders mentioned herein.

The invention relates to a method for the prevention and/or treatment of at least one disease or disorder that is associated with HER2, with its biological or pharmacological activity, and/or with the biological pathways or signalling in which HER2 is involved, said method comprising administering, to a subject in need thereof, a pharmaceutically active amount of an amino acid sequence of the invention, of a Nanobody of the invention, of a polypeptide of the invention, and/or of a pharmaceutical composition comprising the same. In particular, the invention relates to a method for the prevention and/or treatment of at least one disease or disorder that can be treated by modulating HER2, its biological or pharmacological activity, and/or the biological pathways or signalling in which HER2 is involved, said method comprising administering, to a subject in need thereof, a pharmaceutically active amount of an amino acid sequence of the invention, of a Nanobody of the invention, of a polypeptide of the invention, and/or of a pharmaceutical composition comprising the same. In particular, said pharmaceutically effective amount may be an amount that is sufficient to modulate HER2, its biological or pharmacological activity, and/or the biological pathways or signalling in which HER2 is involved; and/or an amount that provides a level of the amino acid sequence of the invention, of a Nanobody of the invention, of a polypeptide of the invention in the circulation that is sufficient to modulate HER2, its biological or pharmacological activity, and/or the biological pathways or signalling in which HER2 is involved.

The invention furthermore relates to a method for the prevention and/or treatment of at least one disease or disorder that can be prevented and/or treated by administering an amino acid sequence of the invention, a Nanobody of the invention or a polypeptide of the invention to a patient, said method comprising administering, to a subject in need thereof, a pharmaceutically active amount of an amino acid sequence of the invention, of a Nanobody of the invention, of a polypeptide of the invention, and/or of a pharmaceutical composition comprising the same.

More in particular, the invention relates to a method for the prevention and/or treatment of at least one disease or disorder chosen from the group consisting of the diseases and disorders listed herein, said method comprising administering, to a subject in need thereof, a pharmaceutically active amount of an amino acid sequence of the invention, of a Nanobody of the invention, of a polypeptide of the invention, and/or of a pharmaceutical composition comprising the same.

In another aspect, the invention relates to a method for immunotherapy, and in particular for passive immunotherapy, which method comprises administering, to a subject suffering from or at risk of the diseases and disorders mentioned herein, a pharmaceutically active amount of an amino acid sequence of the invention, of a Nanobody of the invention, of a polypeptide of the invention, and/or of a pharmaceutical composition comprising the same.

In the above methods, the amino acid sequences, Nanobodies and/or polypeptides of the invention and/or the compositions comprising the same can be administered in any suitable manner, depending on the specific pharmaceutical formulation or composition to be used. Thus, the amino acid sequences, Nanobodies and/or polypeptides of the invention and/or the compositions comprising the same can for example be administered orally, intraperitoneally (e.g. intravenously, subcutaneously, intramuscularly, or via any other route of administration that circumvents the gastrointestinal tract), intranasally, transdermally, topically, by means of a suppository, by inhalation, again depending on the specific pharmaceutical formulation or composition to be used. The clinician will be able to select a suitable route of administration and a suitable pharmaceutical formulation or composition to be used in such administration, depending on the disease or disorder to be prevented or treated and other factors well known to the clinician.

The amino acid sequences, Nanobodies and/or polypeptides of the invention and/or the compositions comprising the same are administered according to a regime of treatment that is suitable for preventing and/or treating the disease or disorder to be prevented or treated. The clinician will generally be able to determine a suitable treatment regimen, depending on factors such as the disease or disorder to be prevented or treated, the severity of the disease to be treated and/or the severity of the symptoms thereof, the specific amino acid sequence, Nanobody or polypeptide of the invention to be used, the specific route of administration and pharmaceutical formulation or composition to be used, the age, gender, weight, diet, general condition of the patient, and similar factors well known to the clinician.

Generally, the treatment regimen will comprise the administration of one or more amino acid sequences, Nanobodies and/or polypeptides of the invention, or of one or more compositions comprising the same, in one or more pharmaceutically effective amounts or doses. The specific amount(s) or doses to administered can be determined by the clinician, again based on the factors cited above.

Generally, for the prevention and/or treatment of the diseases and disorders mentioned herein and depending on the specific disease or disorder to be treated, the potency of the specific amino acid sequence, Nanobody and polypeptide of the invention to be used, the specific route of administration and the specific pharmaceutical formulation or composition used, the amino acid sequences, Nanobodies and polypeptides of the invention will generally be administered in an amount between 1 grain and 0.01 microgram per kg body weight per day, preferably between 0.1 gram and 0.1 microgram per kg body weight per day, such as about 1, 10, 100 or 1000 microgram per kg body weight per day, either continuously (e.g. by infusion), as a single daily dose or as multiple divided doses during the day. The clinician will generally be able to determine a suitable daily dose, depending on the factors mentioned herein. It will also be clear that in specific cases, the clinician may choose to deviate from these amounts, for example on the basis of the factors cited above and his expert judgment. Generally, some guidance on the amounts to be administered can be obtained from the amounts usually administered for comparable conventional antibodies or antibody fragments against the same target administered via essentially the same route, taking into account however differences in affinity/avidity, efficacy, biodistribution, half-life and similar factors well known to the skilled person.

Usually, in the above method, a single amino acid sequence, Nanobody or polypeptide of the invention will be used. It is however within the scope of the invention to use two or more amino acid sequences. Nanobodies and/or polypeptides of the invention in combination.

The Nanobodies, amino acid sequences and polypeptides of the invention may also be used in combination with one or more further pharmaceutically active compounds or principles, i.e. as a combined treatment regimen, which may or may not lead to a synergistic effect. Again, the clinician will be able to select such further compounds or principles, as well as a suitable combined treatment regimen, based on the factors cited above and his expert judgement.

In particular, the amino acid sequences, Nanobodies and polypeptides of the invention may be used in combination with other pharmaceutically active compounds or principles that are or can be used for the prevention and/or treatment of the diseases and disorders cited herein, as a result of which a synergistic effect may or may not be obtained. Examples of such compounds and principles, as well as routes, methods and pharmaceutical formulations or compositions for administering them will be clear to the clinician.

When two or more substances or principles are to be used as part of a combined treatment regimen, they can be administered via the same route of administration or via different routes of administration, at essentially the same time or at different times (e.g. essentially simultaneously, consecutively, or according to an alternating regime). When the substances or principles are to be administered simultaneously via the same route of administration, they may be administered as different pharmaceutical formulations or compositions or part of a combined pharmaceutical formulation or composition, as will be clear to the skilled person.

Also, when two or more active substances or principles are to be used as part of a combined treatment regimen, each of the substances or principles may be administered in the same amount and according to the same regimen as used when the compound or principle is used on its own, and such combined use may or may not lead to a synergistic effect. However, when the combined use of the two or more active substances or principles leads to a synergistic effect, it may also be possible to reduce the amount of one, more or all of the substances or principles to be administered, while still achieving the desired therapeutic action. This may for example be useful for avoiding, limiting or reducing any unwanted side-effects that are associated with the use of one or more of the substances or principles when they are used in their usual amounts, while still obtaining the desired pharmaceutical or therapeutic effect.

The effectiveness of the treatment regimen used according to the invention may be determined and/or followed in any manner known per se for the disease or disorder involved, as will be clear to the clinician. The clinician will also be able, where appropriate and on a case-by-case basis, to change or modify a particular treatment regimen, so as to achieve the desired therapeutic effect, to avoid, limit or reduce unwanted side-effects, and/or to achieve an appropriate balance between achieving the desired therapeutic effect on the one hand and avoiding, limiting or reducing undesired side effects on the other hand.

Generally, the treatment regimen will be followed until the desired therapeutic effect is achieved and/or for as long as the desired therapeutic effect is to be maintained. Again, this can be determined by the clinician.

In another aspect, the invention relates to the use of an amino acid sequence, Nanobody or polypeptide of the invention in the preparation of a pharmaceutical composition for prevention and/or treatment of at least one cancer and/or tumor; and/or for use in one or more of the methods of treatment mentioned herein.

In another aspect, the invention relates to an amino acid sequence, Nanobody or polypeptide of the invention for prevention and/or treatment of at least one cancer and/or tumor; and/or for use in one or more of the methods of treatment mentioned herein.

The subject to be treated may be any warm-blooded animal, but is in particular a mammal, and more in particular a human being. As will be clear to the skilled person, the subject to be treated will in particular be a person suffering from, or at risk of, the diseases and disorders mentioned herein.

The invention also relates to the use of an amino acid sequence, Nanobody or polypeptide of the invention in the preparation of a pharmaceutical composition for the prevention and/or treatment of at least one disease or disorder that can be prevented and/or treated by administering an amino acid sequence, Nanobody or polypeptide of the invention to a patient.

More in particular, the invention relates to the use of an amino acid sequence, Nanobody or polypeptide of the invention in the preparation of a pharmaceutical composition for the prevention and/or treatment of cancers and/or tumors, and in particular for the prevention and treatment of one or more of the diseases and disorders listed herein.

Again, in such a pharmaceutical composition, the one or more amino acid sequences, Nanobodies or polypeptides of the invention may also be suitably combined with one or more other active principles, such as those mentioned herein.

Finally, although the use of the Nanobodies of the invention (as defined herein) and of the polypeptides of the invention is much preferred, it will be clear that on the basis of the description herein, the skilled person will also be able to design and/or generate, in an analogous manner, other amino acid sequences and in particular (single) domain antibodies against HER2, as well as polypeptides comprising such (single) domain antibodies.

For example, it will also be clear to the skilled person that it may be possible to "graft" one or more of the CDR's mentioned above for the Nanobodies of the invention onto such (single) domain antibodies or other protein scaffolds, including but not limited to human scaffolds or non-immunoglobulin scaffolds. Suitable scaffolds and techniques for such CDR grafting will be clear to the skilled person and are well known in the art, see for example U.S. Pat. No. 7,180,370, WO 01/27160, EP 0 605 522, EP 0 460 167, U.S. Pat. No. 7,054,297, Nicaise et al., Protein Science (2004), 13:1882-1891; Ewert et al., Methods, 2004 October; 34(2):184-199; Kettleborough et al., Protein Eng. 1991 October; 4(7): 773-783; O'Brien and Jones, Methods Mol. Biol. 2003:207:81-100; Skerra, J. Mol. Recognit. 2000:13:167-187, and Saerens et al., J. Mol. Biol. 2005 Sep. 23; 352(3):597-607, and the further references cited therein. For example, techniques known per se for grafting mouse or rat CDR's onto human frameworks and scaffolds can be used in an analogous manner to provide chimeric proteins comprising one or more of the CDR's of the Nanobodies of the invention and one or more human framework regions or sequences.

It should also be noted that, when the Nanobodies of the inventions contain one or more other CDR sequences than the preferred CDR sequences mentioned above, these CDR sequences can be obtained in any manner known per se, for example from Nanobodies (preferred), $V_H$ domains from conventional antibodies (and in particular from human antibodies), heavy chain antibodies, conventional 4-chain antibodies (such as conventional human 4-chain antibodies) or other immunoglobulin sequences directed against HER2. Such immunoglobulin sequences directed against HER2 can be generated in any manner known per se, as will be clear to the skilled person, i.e. by immunization with HER2 or by screening a suitable library of immunoglobulin sequences with HER2, or any suitable combination thereof. Optionally, this may be followed by techniques such as random or site-directed mutagenesis and/or other techniques for affinity maturation known per se. Suitable techniques for generating such immunoglobulin sequences will be clear to the skilled person, and for example include the screening techniques reviewed by Hoogenboom, Nature Biotechnology, 23, 9, 1105-1116 (2005) Other techniques for generating immunoglobulins against a specified target include for example the Nanoclone technology (as for example described in the published US patent application 2006-0211088), so-called SLAM technology (as for example described in the European patent application 0 542 810), the use of transgenic mice expressing human immunoglobulins or the well-known hybridoma techniques (see for example Larrick et al, Biotechnology, Vol. 7, 1989, p. 934). All these techniques can be used to generate immunoglobulins against HER2, and the CDR's of such immunoglobulins can be used in the Nanobodies of the invention, i.e. as outlined above. For example, the sequence of such a CDR can be determined, synthesized and/or isolated, and inserted into the sequence of a Nanobody of the invention (e.g. so as to replace the corresponding native CDR), all using techniques known per se such as those described herein, or Nanobodies of the invention containing such CDR's (or nucleic acids encoding the same) can be synthesized de novo, again using the techniques mentioned herein.

Further uses of the amino acid sequences, Nanobodies, polypeptides, nucleic acids, genetic constructs and hosts and host cells of the invention will be clear to the skilled person based on the disclosure herein. For example, and without limitation, the amino acid sequences of the invention can be linked to a suitable carrier or solid support so as to provide a medium than can be used in a manner known per se to purify HER2 from compositions and preparations comprising the same. Derivatives of the amino acid sequences of the invention that comprise a suitable detectable label can also be used as markers to determine (qualitatively or quantitatively) the presence of HER2 in a composition or preparation or as a marker to selectively detect the presence of HER2 on the surface of a cell or tissue (for example, in combination with suitable cell sorting techniques).

The invention will now be further described by means of the following non-limiting preferred aspects, examples and figures:

PREFERRED ASPECTS

1. Amino acid sequence that is directed against and/or that can specifically bind to HER2.

2. Amino acid sequence according to aspect 1, wherein said amino acid sequence competes with Herceptin® for binding to HER2.

3. Amino acid sequence according to any of aspects 1 or 2, wherein said amino acid sequence inhibits and/or blocks binding of Herceptin® to HER 4. Amino acid sequence according to any of aspects 1 to 3, wherein said amino acid sequence is directed against the Herceptin® binding site on HER2.

5. Amino acid sequence according to any of aspects 1 to 4, wherein said amino acid sequence specifically binds to domain IV of HER2.

6. Amino acid sequence according to aspect 1, wherein said amino acid sequence competes with Omnitarg for binding to HER2.

7. Amino acid sequence according to any of aspect 1 or 7, wherein said amino acid sequence inhibits and/or blocks binding of Omnitarg to HER2.

8. Amino acid sequence according to any of aspects 6 or 7, wherein said amino acid sequence is directed against the Omnitarg binding site on HER2.

9. Amino acid sequence according to any of aspects 6 to 8, wherein said amino acid sequence specifically binds to domain II of HER2.

10. Amino acid sequence according to any of aspects 1 to 9, wherein said amino acid competes with Herceptin® and Omnitarg for binding to HER2.

11. Amino acid sequence according to any of aspects 1 to 10, wherein said amino acid sequence inhibits and/or blocks binding of Herceptin® and Omnitarg to HER2.

12. Amino acid sequence according to any of aspects 1 to 11, wherein said amino acid sequence inhibits and/or blocks tumor cell proliferation.

13. Amino acid sequence according to any of aspects 1 to 12, wherein said amino acid sequence inhibits, downregulates and/or blocks cell signalling.

14. Amino acid sequence according to any of aspects 1 to 13, wherein said amino acid sequence induces apoptosis in tumor cells.

15. Amino acid sequence according to any of aspects 1 to 14, wherein said amino acid sequence inhibits and/or blocks heterodimerization between ERBB receptors.

16. Amino acid sequence according to any of aspects 1 to 15, wherein said amino acid sequence inhibits and/or blocks ligand activation of an ERbB hetero-oligomer comprising HER2 and HER3, HER4 or EGFR.

17. Amino acid sequence according to any of aspects 1 to 16, wherein said amino acid sequence inhibits and/or blocks tumor vascularisation.

18. Amino acid sequence according to any of aspects Ito 17, wherein said amino acid sequence recruits immune effector cells such as macrophages and monocytes to the tumor.

19. Amino acid sequence according to any of aspects 1 to 18, wherein said amino acid sequence inhibits and/or blocks TNF induced signalling and/or cell proliferation.

20. Amino acid sequence according to any of aspects 1 to 19, wherein said amino acid sequence downregulates HER2 levels and/or downregulates HER2-mediated signalling pathways.

21. Amino acid sequence according to any of aspects 1 to 20, wherein said amino acid sequence inhibits and/or blocks metalloproteinase-mediated HER2 ectodomain shedding.

22. Amino acid sequence according to any of aspects 1 to 21, wherein said amino acid sequence inhibits, downregulates and/or blocks ligand-mediated ErbB signalling.

23. Amino acid sequence according to any of aspects 1 to 22, wherein said amino acid sequence inhibits and/or blocks HER2 ectodomain cleavage.
24. Amino acid sequence according to any of aspects 1 to 23, wherein said amino acid sequence inhibits and/or blocks Heregulin-mediated activation of MAPK/Erk1/2.
25. Amino acid sequence according to any of aspects 1 to 24, wherein said amino acid sequence inhibits and/or blocks P13K/Akt signalling.
26. Amino acid sequence according to any of aspects 1 to 25, wherein said amino acid sequence modulates HER2 or HER2 mediated signalling via the same mechanism of action as Herceptin®.
27. Amino acid sequence according to any of aspects 1 to 26, wherein said amino acid sequence modulates HER2 or HER2 mediated signalling via the same mechanism of action as Omnitarg.
28. Amino acid sequence according to any of aspects 1 to 27, that is in essentially isolated form.
29. Amino acid sequence according to aspect 1 or 28, for administration to a subject, wherein said amino acid sequence does not naturally occur in said subject.
30. Amino acid sequence according to any of aspects 1 to 29, that can specifically bind to HER2 with a dissociation constant ($K_D$) of $10^{-5}$ to $10^{-12}$ moles/litre or less, and preferably $10^{-7}$ to $10^{-12}$ moles/litre or less and more preferably $10^{-8}$ to $10^{-12}$ moles/litre.
31. Amino acid sequence according to any of aspects 1 to 30, that can specifically bind to HER2 with a rate of association ($k_{on}$-rate) of between $10^2$ $M^{-1}$ $s^{-1}$ to about $10^7$ $M^{-1}$ $s^{-1}$ preferably between $10^3$ $M^{-1}$ $s^{-1}$ and $10^7$ $M^{-1}$ $s^{-1}$, more preferably between $10^4$ $M^{-1}$ $s^{-1}$ and $10^7$ $M^{-1}$ $s^{-1}$, such as between $10^5$ $M^{-1}$ $s^{-1}$ and $10^7$ $M^{-1}$ $s^{-1}$.
32. Amino acid sequence according to any of aspects 1 to 31, that can specifically bind to HER2 with a rate of dissociation ($k_{off}$ rate) between 1 $s^{-1}$ and $10^{-6}$ $s^{-1}$, preferably between $10^{-2}$ $s^{-1}$ and $10^{-6}$ $s^{-1}$, more preferably between $10^{-3}$ $s^{-1}$ and $10^{-6}$ $s^{-1}$, such as between $10^{-4}$ $s^{-1}$ and $10^{-6}$ $s^{-1}$.
33. Amino acid sequence according to any of aspects 1 to 32, that can specifically bind to HER2 with an affinity less than 500 nM, preferably less than 200 nM, more preferably less than 10 nM, such as less than 500 μM.
34. Amino acid sequence according to any of aspects 1 to 33, that is a naturally occurring amino acid sequence (from any suitable species) or a synthetic or semi-synthetic amino acid sequence.
35. Amino acid sequence according to any of aspects 1 to 34, that comprises an immunoglobulin fold or that under suitable conditions is capable of forming an immunoglobulin fold.
36. Amino acid sequence according to any of aspects 1 to 35, that essentially consists of 4 framework regions (FR1 to FR4 respectively) and 3 complementarity determining regions (CDR1 to CDR3 respectively).
37. Amino acid sequence according to any of aspects 1 to 36, that is an immunoglobulin sequence.
38. Amino acid sequence according to any of aspects 1 to 37, that is a naturally occurring immunoglobulin sequence (from any suitable species) or a synthetic or semi-synthetic immunoglobulin sequence.
39. Amino acid sequence according to any of aspects 1 to 38, that is a humanized immunoglobulin sequence, a camelized immunoglobulin sequence or an immunoglobulin sequence that has been obtained by techniques such as affinity maturation.
40. Amino acid sequence according to any of aspects 1 to 39, that essentially consists of a light chain variable domain sequence (e.g. a $V_L$-sequence); or of a heavy chain variable domain sequence (e.g. a $V_H$-sequence).
41. Amino acid sequence according to any of aspects 1 to 40, that essentially consists of a heavy chain variable domain sequence that is derived from a conventional four-chain antibody or that essentially consist of a heavy chain variable domain sequence that is derived from heavy chain antibody.
42. Amino acid sequence according to any of aspects 1 to 41, that essentially consists of a domain antibody (or an amino acid sequence that is suitable for use as a domain antibody), of a single domain antibody (or an amino acid sequence that is suitable for use as a single domain antibody), of a "dAb" (or an amino acid sequence that is suitable for use as a dAb) or of a Nanobody® (including but not limited to a $V_{HH}$ sequence).
43. Amino acid sequence according to any of aspects 1 to 42, that essentially consists of a Nanobody®.
44. Amino acid sequence according to any of aspects 1 to 43, that essentially consists of a Nanobody® that
   i) has at least 80% amino acid identity with at least one of the amino acid sequences of SEQ ID NO's: 1 to 22, in which for the purposes of determining the degree of amino acid identity, the amino acid residues that form the CDR sequences are disregarded;
   and in which:
   ii) preferably one or more of the amino acid residues at positions 11, 37, 44, 45, 47, 83, 84, 103, 104 and 108 according to the Kabat numbering are chosen from the Hallmark residues mentioned in Table A-3.
45. Amino acid sequence according to any of aspects 1 to 44, that essentially consists of a Nanobody® that
   i) has at least 80% amino acid identity with at least one of the amino acid sequences of SEQ ID NO's: 2051-2325, in which for the purposes of determining the degree of amino acid identity, the amino acid residues that form the CDR sequences are disregarded;
   and in which:
   ii) preferably one or more of the amino acid residues at positions 11, 37, 44, 45, 47, 83, 84, 103, 104 and 108 according to the Kabat numbering are chosen from the Hallmark residues mentioned in Table A-3.
46. Amino acid sequence according to any of aspects 1 to 45, that essentially consists of a humanized Nanobody®.
47. Amino acid sequence according to any of aspects 1 to 46, that in addition to the at least one binding site for binding against HER2, contains one or more further binding sites for binding against other antigens, proteins or targets.
48. Amino acid sequence directed against HER2, that comprises one or more stretches of amino acid residues chosen from the group consisting of:
   a) the amino acid sequences of SEQ ID NO's: 401-675;
   b) amino acid sequences that have at least 80% amino acid identity with at least one of the amino acid sequences of SEQ ID NO's: 401-675;
   c) amino acid sequences that have 3, 2, or 1 amino acid difference with at least one of the amino acid sequences of SEQ ID NO's: 401-675;
   d) the amino acid sequences of SEQ ID NO's: 951-1225;
   e) amino acid sequences that have at least 80% amino acid identity with at least one of the amino acid sequences of SEQ ID NO's: 951-1225;
   f) amino acid sequences that have 3, 2, or 1 amino acid difference with at least one of the amino acid sequences of SEQ ID NO's: 951-1225;

g) the amino acid sequences of SEQ ID NO's: 1501-1775;
h) amino acid sequences that have at least 80% amino acid identity with at least one of the amino acid sequences of SEQ ID NO's: 1501-1775;
i) amino acid sequences that have 3, 2, or 1 amino acid difference with at least one of the amino acid sequences of SEQ ID NO's: 1501-1775;
or any suitable combination thereof.

49. Amino acid sequence according to aspect 48, in which at least one of said stretches of amino acid residues forms part of the antigen binding site for binding against HER2.

50. Amino acid sequence according to any of aspects 48 or 49, that comprises two or more stretches of amino acid residues chosen from the group consisting of:
a) the amino acid sequences of SEQ ID NO's: 401-675;
b) amino acid sequences that have at least 80% amino acid identity with at least one of the amino acid sequences of SEQ ID NO's: 401-675;
c) amino acid sequences that have 3, 2, or 1 amino acid difference with at least one of the amino acid sequences of SEQ ID NO's: 401-675;
d) the amino acid sequences of SEQ ID NO's: 951-1225;
e) amino acid sequences that have at least 80% amino acid identity with at least one of the amino acid sequences of SEQ ID NO's: 951-1225;
f) amino acid sequences that have 3, 2, or 1 amino acid difference with at least one of the amino acid sequences of SEQ ID NO's: 951-1225;
g) the amino acid sequences of SEQ ID NO's: 1501-1775;
h) amino acid sequences that have at least 80% amino acid identity with at least one of the amino acid sequences of SEQ ID NO's: 1501-1775;
i) amino acid sequences that have 3, 2, or 1 amino acid difference with at least one of the amino acid sequences of SEQ ID NO's: 1501-1775;
such that (i) when the first stretch of amino acid residues corresponds to one of the amino acid sequences according to a), b) or c), the second stretch of amino acid residues corresponds to one of the amino acid sequences according to d), e), f), g), f) or i); (ii) when the first stretch of amino acid residues corresponds to one of the amino acid sequences according to d), e) or f), the second stretch of amino acid residues corresponds to one of the amino acid sequences according to a), b), c), g), h) or i); or (iii) when the first stretch of amino acid residues corresponds to one of the amino acid sequences according to g), h) or i), the second stretch of amino acid residues corresponds to one of the amino acid sequences according to a), b), c), d), e) or f).

51. Amino acid sequence according to aspect 50, in which the at least two stretches of amino acid residues forms part of the antigen binding site for binding against HER2.

52. Amino acid sequence according to any of aspects 48 to 51, that comprises three or more stretches of amino acid residues, in which the first stretch of amino acid residues is chosen from the group consisting of:
a) the amino acid sequences of SEQ ID NO's: 401-675;
b) amino acid sequences that have at least 80% amino acid identity with at least one of the amino acid sequences of SEQ ID NO's: 401-675;
c) amino acid sequences that have 3, 2, or 1 amino acid difference with at least one of the amino acid sequences of SEQ ID NO's: 401-675;
the second stretch of amino acid residues is chosen from the group consisting of:
d) the amino acid sequences of SEQ ID NO's: 951-1225;
e) amino acid sequences that have at least 80% amino acid identity with at least one of the amino acid sequences of SEQ ID NO's: 951-1225;
f) amino acid sequences that have 3, 2, or 1 amino acid difference with at least one of the amino acid sequences of SEQ ID NO's: 951-1225;
and the third stretch of amino acid residues is chosen from the group consisting of:
g) the amino acid sequences of SEQ ID NO's: 1501-1775;
h) amino acid sequences that have at least 80% amino acid identity with at least one of the amino acid sequences of SEQ ID NO's: 1501-1775;
i) amino acid sequences that have 3, 2, or 1 amino acid difference with at least one of the amino acid sequences of SEQ ID NO's: 1501-1775.

53. Amino acid sequence according to aspect 52, in which the at least three stretches of amino acid residues forms part of the antigen binding site for binding against HER2.

54. Amino acid sequence according to any of aspects 48 to 53, in which the CDR sequences of said amino acid sequence have at least 70% amino acid identity, preferably at least 80% amino acid identity, more preferably at least 90% amino acid identity, such as 95% amino acid identity or more or even essentially 100% amino acid identity with the CDR sequences of at least one of the amino acid sequences of SEQ ID NO's: 2051-2325.

55. Amino acid sequence directed against HER2 that cross-blocks the binding of at least one of the amino acid sequences according to any of aspects 48 to 54 to HER2.

56. Amino acid sequence directed against HER2 that is cross-blocked from binding to HER2 by at least one of the amino acid sequences according to any of aspects 48 to 54.

57. Amino acid sequence according to any of aspects 55 or 56, wherein the ability of said amino acid sequence to cross-block or to be cross-blocked is detected in a Biacore assay.

58. Amino acid sequence according to any of aspects 55 to 57, wherein the ability of said amino acid sequence to cross-block or to be cross-blocked is detected in an ELISA assay.

59. Amino acid sequence according to any of aspects 58 to 58, that is in essentially isolated form.

60. Amino acid sequence according to any of aspects 48 to 59, for administration to a subject, wherein said amino acid sequence does not naturally occur in said subject.

61. Amino acid sequence according to any of aspects 48 to 60, that can specifically bind to HER2 with a dissociation constant ($K_D$) of $10^{-5}$ to $10^{-12}$ moles/litre or less, and preferably $10^{-7}$ to $10^{-12}$ moles/litre or less and more preferably $10^{-8}$ to $10^{-12}$ moles/litre.

62. Amino acid sequence according to any of aspects 48 to 61, that can specifically bind to HER2 with a rate of association ($k_{on}$-rate) of between $10^2$ $M^{-1}$ $s^{-1}$ to about $10^7$ $M^{-1}$ $s^{-1}$, preferably between $10^3$ $M^{-1}$ $s^{-1}$ and $10^7$ $M^{-1}$ $s^{-1}$, more preferably between $10^4$ $M^{-1}$ $s^{-1}$ and $10^7$ $M^{-1}$ $s^{-1}$, such as between $10^5$ $M^{-1}$ $s^{-1}$ and $10^7$ $M^{-1}$ $s^{-1}$.

63. Amino acid sequence according to any of aspects 48 to 62, that can specifically bind to HER2 with a rate of dissociation ($k_{off}$ rate) between $1$ $s^{-1}$ and $10^{-6}$ $s^{-1}$ preferably between $10^{-2}$ $s^{-1}$ and $10^{-6}$ $s^{-1}$, more preferably between $10^{-3}$ $s^{-1}$ and $10^{-6}$ $s^{-1}$, such as between $10^{-4}$ $s^{-1}$ and $10^{-6}$ $s^{-1}$.

64. Amino acid sequence according to any of aspects 48 to 63, that can specifically bind to HER2 with an affinity less than 500 nM, preferably less than 200 nM, more preferably less than 10 nM, such as less than 500 μM.

65. Amino acid sequence according to any of aspects 48 to 64, that is a naturally occurring amino acid sequence (from any suitable species) or a synthetic or semi-synthetic amino acid sequence.
66. Amino acid sequence according to any of aspects 48 to 65, that comprises an immunoglobulin fold or that under suitable conditions is capable of forming an immunoglobulin fold.
67. Amino acid sequence according to any of aspects 48 to 66, that is an immunoglobulin sequence.
68. Amino acid sequence according to any of aspects 48 to 67, that is a naturally occurring immunoglobulin sequence (from any suitable species) or a synthetic or semi-synthetic immunoglobulin sequence.
69. Amino acid sequence according to any of aspects 48 to 68, that is a humanized immunoglobulin sequence, a camelized immunoglobulin sequence or an immunoglobulin sequence that has been obtained by techniques such as affinity maturation.
70. Amino acid sequence according to any of aspects 48 to 69, that essentially consists of a light chain variable domain sequence (e.g. a $V_L$-sequence); or of a heavy chain variable domain sequence (e.g. a $V_H$-sequence).
71. Amino acid sequence according to any of aspects 48 to 70, that essentially consists of a heavy chain variable domain sequence that is derived from a conventional four-chain antibody or that essentially consist of a heavy chain variable domain sequence that is derived from heavy chain antibody.
72. Amino acid sequence according to any of aspects 48 to 71, that essentially consists of a domain antibody (or an amino acid sequence that is suitable for use as a domain antibody), of a single domain antibody (or an amino acid sequence that is suitable for use as a single domain antibody), of a "dAb" (or an amino acid sequence that is suitable for use as a dAb) or of a Nanobody® (including but not limited to a $V_{HH}$ sequence).
73. Amino acid sequence according to any of aspects 48 to 72, that essentially consists of a Nanobody®.
74. Amino acid sequence according to any of aspects 48 to 73, that essentially consists of a Nanobody® that
    i) has at least 80% amino acid identity with at least one of the amino acid sequences of SEQ ID NO's: 1 to 22, in which for the purposes of determining the degree of amino acid identity, the amino acid residues that form the CDR sequences are disregarded;
    and in which:
    ii) preferably one or more of the amino acid residues at positions 11, 37, 44, 45, 47, 83, 84, 103, 104 and 108 according to the Kabat numbering are chosen from the Hallmark residues mentioned in Table A-3.
75. Amino acid sequence according to any of aspects 48 to 74, that essentially consists of a Nanobody® that
    i) has at least 80% amino acid identity with at least one of the amino acid sequences of SEQ ID NO's: 2051-2325, in which for the purposes of determining the degree of amino acid identity, the amino acid residues that form the CDR sequences are disregarded;
    and in which:
    ii) preferably one or more of the amino acid residues at positions 11, 37, 44, 45, 47, 83, 84, 103, 104 and 108 according to the Kabat numbering are chosen from the Hallmark residues mentioned in Table A-3.
76. Amino acid sequence according to any of aspects 48 to 75, that essentially consists of a humanized Nanobody®.
77. Amino acid sequence according to any of aspects 1 to 76, that in addition to the at least one binding site for binding formed by the CDR sequences, contains one or more further binding sites for binding against other antigens, proteins or targets.
78. Amino acid sequence that essentially consists of 4 framework regions (FR1 to FR4, respectively) and 3 complementarity determining regions (CDR1 to CDR3, respectively), in which:
    CDR1 is chosen from the group consisting of:
    a) the amino acid sequences of SEQ ID NO's: 401-675;
    b) amino acid sequences that have at least 80% amino acid identity with at least one of the amino acid sequences of SEQ ID NO's: 401-675;
    c) amino acid sequences that have 3, 2, or 1 amino acid difference with at least one of the amino acid sequences of SEQ ID NO's: 401-675;
    and/or
    CDR2 is chosen from the group consisting of:
    d) the amino acid sequences of SEQ ID NO's: 951-1225;
    e) amino acid sequences that have at least 80% amino acid identity with at least one of the amino acid sequences of SEQ ID NO's: 951-1225;
    f) amino acid sequences that have 3, 2, or 1 amino acid difference with at least one of the amino acid sequences of SEQ ID NO's: 951-1225;
    and/or
    CDR3 is chosen from the group consisting of:
    g) the amino acid sequences of SEQ ID NO's: 1501-1775;
    h) amino acid sequences that have at least 80% amino acid identity with at least one of the amino acid sequences of SEQ ID NO's: 1501-1775;
    i) amino acid sequences that have 3, 2, or 1 amino acid difference with at least one of the amino acid sequences of SEQ ID NO's: 1501-1775.
79. Amino acid sequence that essentially consists of 4 framework regions (FR1 to FR4, respectively) and 3 complementarity determining regions (CDR1 to CDR3, respectively), in which:
    CDR1 is chosen from the group consisting of:
    a) the amino acid sequences of SEQ ID NO's: 401-675;
    b) amino acid sequences that have at least 80% amino acid identity with at least one of the amino acid sequences of SEQ ID NO's: 401-675;
    c) amino acid sequences that have 3, 2, or 1 amino acid difference with at least one of the amino acid sequences of SEQ ID NO's: 401-675;
    and
    CDR2 is chosen from the group consisting of:
    d) the amino acid sequences of SEQ ID NO's: 951-1225;
    e) amino acid sequences that have at least 80% amino acid identity with at least one of the amino acid sequences of SEQ ID NO's: 951-1225;
    f) amino acid sequences that have 3, 2, or 1 amino acid difference with at least one of the amino acid sequences of SEQ ID NO's: 951-1225;
    and
    CDR3 is chosen from the group consisting of:
    g) the amino acid sequences of SEQ ID NO's: 1501-1775;
    h) amino acid sequences that have at least 80% amino acid identity with at least one of the amino acid sequences of SEQ ID NO's: 1501-1775;
    i) amino acid sequences that have 3, 2, or 1 amino acid difference with at least one of the amino acid sequences of SEQ ID NO's: 1501-1775].
80. Amino acid sequence according to any of aspects 78 to 79, in which the CDR sequences of said amino acid sequence have at least 70% amino acid identity, preferably at least 80% amino acid identity, more preferably at least 90% amino acid identity, such as 95% amino acid identity or more or even essentially 100% amino acid identity with the CDR sequences of at least one of the amino acid sequences of SEQ ID NO's: 2051-2325.

81. Amino acid sequence directed against HER2 that cross-blocks the binding of at least one of the amino acid sequences according to any of aspects 78 to 80 to HER2.

82. Amino acid sequence directed against HER2 that is cross-blocked from binding to HER2 by at least one of the amino acid sequences according to any of aspects 78 to 80.

83. Amino acid sequence according to any of aspects 81 or 82, wherein the ability of said amino acid sequence to cross-block or to be cross-blocked is detected in a Biacore assay.

84. Amino acid sequence according to any of aspects 81 to 83, wherein the ability of said amino acid sequence to cross-block or to be cross-blocked is detected in an ELISA assay.

85. Amino acid sequence according to any of aspects 78 to 84, that is in essentially isolated form.

86. Amino acid sequence according to any of aspects 78 to 85, for administration to a subject, wherein said amino acid sequence does not naturally occur in said subject.

87. Amino acid sequence according to any of aspects 78 to 86, that can specifically bind to HER2 with a dissociation constant ($K_D$) of $10^{-5}$ to $10^{-12}$ moles/litre or less, and preferably $10^{-7}$ to $10^{-12}$ moles/litre or less and more preferably $10^{-8}$ to $10^{-12}$ moles/litre.

88. Amino acid sequence according to any of aspects 78 to 87, that can specifically bind to HER2 with a rate of association ($k_{on}$-rate) of between $10^2$ $M^{-1}$ $s^{-1}$ to about $10^7$ $M^{-1}$ $s^{-1}$, preferably between $10^3$ $M^{-1}$ $s^{-1}$ and $10^7$ $M^{-1}$ $s^{-1}$, more preferably between $10^4$ $M^{-1}$ $s^{-1}$ and $10^7$ $M^{-1}$ $s^{-1}$, such as between $10^5$ $M^{-1}$ $s^{-1}$ and $10^7$ $M^{-1}$ $s^{-1}$.

89. Amino acid sequence according to any of aspects 78 to 88, that can specifically bind to HER2 with a rate of dissociation ($k_{off}$ rate) between $1$ $s^{-1}$ and $10^{-6}$ $s^{-1}$ preferably between $10^{-2}$ $s^{-1}$ and $10^{-6}$ $s^{-1}$, more preferably between $10^{-3}$ $s^{-1}$ and $10^{-6}$ $s^{-1}$, such as between $10^{-4}$ $s^{-1}$ and $10^{-6}$ $s^{-1}$.

90. Amino acid sequence according to any of aspects 78 to 89, that can specifically bind to HER2 with an affinity less than 500 nM, preferably less than 200 nM, more preferably less than 10 nM, such as less than 500 μM.

91. Amino acid sequence according to any of aspects 78 to 90, that is a naturally occurring amino acid sequence (from any suitable species) or a synthetic or semi-synthetic amino acid sequence.

92. Amino acid sequence according to any of aspects 78 to 91, that comprises an immunoglobulin fold or that under suitable conditions is capable of forming an immunoglobulin fold.

93. Amino acid sequence according to any of aspects 78 to 92, that is an immunoglobulin sequence.

94. Amino acid sequence according to any of aspects 78 to 93, that is a naturally occurring immunoglobulin sequence (from any suitable species) or a synthetic or semi-synthetic immunoglobulin sequence.

95. Amino acid sequence according to any of aspects 78 to 94, that is a humanized immunoglobulin sequence, a camelized immunoglobulin sequence or an immunoglobulin sequence that has been obtained by techniques such as affinity maturation.

96. Amino acid sequence according to any of aspects 78 to 95, that essentially consists of a light chain variable domain sequence (e.g. a $V_L$-sequence); or of a heavy chain variable domain sequence (e.g. a $V_H$-sequence).

97. Amino acid sequence according to any of aspects 78 to 96, that essentially consists of a heavy chain variable domain sequence that is derived from a conventional four-chain antibody or that essentially consist of a heavy chain variable domain sequence that is derived from heavy chain antibody.

98. Amino acid sequence according to any of aspects 78 to 97, that essentially consists of a domain antibody (or an amino acid sequence that is suitable for use as a domain antibody), of a single domain antibody (or an amino acid sequence that is suitable for use as a single domain antibody), of a "dAb" (or an amino acid sequence that is suitable for use as a dAb) or of a Nanobody® (including but not limited to a $V_{HH}$ sequence).

99. Amino acid sequence according to any of aspects 78 to 98, that essentially consists of a Nanobody®.

100. Amino acid sequence according to any of aspects 78 to 99, that essentially consists of a Nanobody® that
   i) has at least 80% amino acid identity with at least one of the amino acid sequences of SEQ ID NO's: 1 to 22, in which for the purposes of determining the degree of amino acid identity, the amino acid residues that form the CDR sequences are disregarded;
   and in which:
   ii) preferably one or more of the amino acid residues at positions 11, 37, 44, 45, 47, 83, 84, 103, 104 and 108 according to the Kabat numbering are chosen from the Hallmark residues mentioned in Table A-3.

101. Amino acid sequence according to any of aspects 78 to 100, that essentially consists of a Nanobody® that
   i) has at least 80% amino acid identity with at least one of the amino acid sequences of SEQ ID NO's: 2051-2325, in which for the purposes of determining the degree of amino acid identity, the amino acid residues that form the CDR sequences are disregarded;
   and in which:
   ii) preferably one or more of the amino acid residues at positions 11, 37, 44, 45, 47, 83, 84, 103, 104 and 108 according to the Kabat numbering are chosen from the Hallmark residues mentioned in Table A-3.

102. Amino acid sequence according to any of aspects 78 to 101, that essentially consists of a humanized Nanobody®.

103. Amino acid sequence according to any of aspects 78 to 102, that in addition to the at least one binding site for binding formed by the CDR sequences, contains one or more further binding sites for binding against other antigens, proteins or targets.

104. Nanobody that is directed against and/or that can specifically bind to HER2.

105. Nanobody according to aspect 104, wherein said Nanobody competes with Herceptin® for binding to HER2.

106. Nanobody according to any of aspects 104 or 105, wherein said Nanobody inhibits and/or blocks binding of Herceptin® to HER2.

107. Nanobody according to any of aspects 104 to 106, wherein said Nanobody is directed against the Herceptin® binding site on HER2.

108. Nanobody according to any of aspects 104 to 107, wherein said Nanobody specifically binds to domain IV of HER2.

109. Nanobody according to aspect 104, wherein said Nanobody competes with Omnitarg for binding to HER2.

110. Nanobody according to any of aspects 104 or 109, wherein said Nanobody inhibits and/or blocks binding of Omnitarg to HER2.

111. Nanobody according to any of aspects 109 or 110, wherein said Nanobody is directed against the Omnitarg binding site on HER2.

112. Nanobody according to any of aspects 109 to 111, wherein said Nanobody specifically binds to domain II of HER2.
113. Nanobody according to any of aspects 104 to 112, wherein said Nanobody competes with Herceptin® and Omnitarg for binding to HER2.
114. Nanobody according to any of aspects 104 to 113, wherein said Nanobody inhibits and/or blocks binding of Herceptin® and Omnitarg to HER2.
115. Nanobody according to any of aspects 104 to 114, wherein said Nanobody inhibits and/or blocks tumor cell proliferation.
116. Nanobody according to any of aspects 104 to 115, wherein said Nanobody inhibits, downregulates and/or blocks cell signalling.
117. Nanobody according to any of aspects 104 to 116, wherein said Nanobody induces apoptosis in tumor cells.
118. Nanobody according to any of aspects 104 to 117, wherein said Nanobody inhibits and/or blocks heterodimerization between ERBB receptors.
119. Nanobody according to any of aspects 104 to 118, wherein said Nanobody inhibits and/or blocks ligand activation of an ERbB hetero-oligomer comprising HER2 and HER3, HER4 or EGFR.
120. Nanobody according to any of aspects 104 to 119, wherein said Nanobody inhibits and/or blocks tumor vascularisation.
121. Nanobody according to any of aspects 104 to 120, wherein said Nanobody recruits immune effector cells such as macrophages and monocytes to the tumor.
122. Nanobody according to any of aspects 104 to 121, wherein said Nanobody inhibits and/or blocks TNF induced signalling and/or cell proliferation.
123. Nanobody according to any of aspects 104 to 122, wherein said Nanobody downregulates HER2 levels and/or downregulates HER2-mediated signalling pathways.
124. Nanobody according to any of aspects 104 to 123, wherein said Nanobody inhibits and/or blocks metalloproteinase-mediated HER2 ectodomain shedding.
125. Nanobody according to any of aspects 104 to 124, wherein said Nanobody downregulates and/or blocks ligand-mediated ErbB signalling.
126. Nanobody according to any of aspects 104 to 125, wherein said Nanobody inhibits and/or blocks HER2 ectodomain cleavage.
127. Nanobody according to any of aspects 104 to 126, wherein said Nanobody inhibits and/or blocks Heregulin-mediated activation of MAPK/Erk1/2.
128. Nanobody according to any of aspects 104 to 127, wherein said Nanobody inhibits and/or blocks PI3K/Akt signalling.
129. Nanobody according to any of aspects 104 to 128, wherein said Nanobody modulates HER2 or HER2 mediated signalling via the same mechanism of action as Herceptin®.
130. Nanobody according to any of aspects 104 to 129, wherein said Nanobody modulates HER2 or HER2 mediated signalling via the same mechanism of action as Omnitarg.
131. Nanobody according to any of aspects 104 to 130, that is in essentially isolated form.
132. Nanobody according to any of aspects 104 to 131, that can specifically bind to HER2 with a dissociation constant ($K_D$) of $10^{-5}$ to $10^{-12}$ moles/litre or less, and preferably $10^{-7}$ to $10^{-12}$ moles/litre or less and more preferably $10^{-8}$ to $10^{-12}$ moles/litre.
133. Nanobody according to any of aspects 104 to 132, that can specifically bind to HER2 with a rate of association ($k_{on}$-rate) of between $10^2$ $M^{-1}$ $s^{-1}$ to about $10^7$ $M^{-1}$ $s^{-1}$, preferably between $10^3$ $M^{-1}$ $s^{-1}$ and $10^7$ $M^{-1}$ $s^{-1}$, more preferably between $10^4$ $M^{-1}$ $s^{-1}$ and $10^7$ $M^{-1}$ $s^{-1}$, such as between $10^5$ $M^{-1}$ $s^{-1}$ and $10^7$ $M^{-1}$ $s^{-1}$.
134. Nanobody according to any of aspects 104 to 133, that can specifically bind to HER2 with a rate of dissociation ($k_{off}$-rate) between 1 $s^{-1}$ and $10^{-6}$ $s^{-1}$ preferably between $10^{-2}$ $s^{-1}$ and $10^{-6}$ $s^{-1}$, more preferably between $10^{-3}$ $s^{-1}$ and $10^{-6}$ $s^{-1}$, such as between $10^{-4}$ $s^{-1}$ and $10^{-6}$ $s^{-1}$.
135. Nanobody according to any of aspects 104 to 134, that can specifically bind to HER2 with an affinity less than 500 nM, preferably less than 200 nM, more preferably less than 10 nM, such as less than 500 µM.
136. Nanobody according to any of aspects 104 to 135, that is a naturally occurring Nanobody (from any suitable species) or a synthetic or semi-synthetic Nanobody.
137. Nanobody according to any of aspects 104 to 136, that is a $V_{HH}$ sequence, a partially humanized $V_{HH}$ sequence, a fully humanized $V_{HH}$ sequence, a camelized heavy chain variable domain or a Nanobody that has been obtained by techniques such as affinity maturation.
138. Nanobody according to any of aspects 104 to 137, that
i) has at least 80% amino acid identity with at least one of the amino acid sequences of SEQ ID NO's: 1 to 22, in which for the purposes of determining the degree of amino acid identity, the amino acid residues that form the CDR sequences are disregarded;
and in which:
ii) preferably one or more of the amino acid residues at positions 11, 37, 44, 45, 47, 83, 84, 103, 104 and 108 according to the Kabat numbering are chosen from the Hallmark residues mentioned in Table A-3.
139. Nanobody according to any of aspects 104 to 138, that
i) has at least 80% amino acid identity with at least one of the amino acid sequences of SEQ ID NO's: 2051-2325, in which for the purposes of determining the degree of amino acid identity, the amino acid residues that form the CDR sequences are disregarded;
and in which:
ii) preferably one or more of the amino acid residues at positions 11, 37, 44, 45, 47, 83, 84, 103, 104 and 108 according to the Kabat numbering are chosen from the Hallmark residues mentioned in Table A-3.
140. Nanobody according to any of aspects 104 to 139, in which:
CDR1 is chosen from the group consisting of:
a) the amino acid sequences of SEQ ID NO's: 401-675;
b) amino acid sequences that have at least 80% amino acid identity with at least one of the amino acid sequences of SEQ ID NO's: 401-675;
c) amino acid sequences that have 3, 2, or 1 amino acid difference with at least one of the amino acid sequences of SEQ ID NO's: 401-675;
and/or
CDR2 is chosen from the group consisting of:
d) the amino acid sequences of SEQ ID NO's: 951-1225;
e) amino acid sequences that have at least 80% amino acid identity with at least one of the amino acid sequences of SEQ ID NO's: 951-1225;
f) amino acid sequences that have 3, 2, or 1 amino acid difference with at least one of the amino acid sequences of SEQ ID NO's: 951-1225;

and/or
CDR3 is chosen from the group consisting of:
g) the amino acid sequences of SEQ ID NO's: 1501-1775;
h) amino acid sequences that have at least 80% amino acid identity with at least one of the amino acid sequences of SEQ ID NO's: 1501-1775;
i) amino acid sequences that have 3, 2, or 1 amino acid difference with at least one of the amino acid sequences of SEQ ID NO's: 1501-1775.

141. Nanobody according to any of aspects 104 to 140, in which:
CDR1 is chosen from the group consisting of:
a) the amino acid sequences of SEQ ID NO's: 401-675;
b) amino acid sequences that have at least 80% amino acid identity with at least one of the amino acid sequences of SEQ ID NO's: 401-675;
c) amino acid sequences that have 3, 2, or 1 amino acid difference with at least one of the amino acid sequences of SEQ ID NO's: 401-675;
and
CDR2 is chosen from the group consisting of:
d) the amino acid sequences of SEQ ID NO's: 951-1225;
e) amino acid sequences that have at least 80% amino acid identity with at least one of the amino acid sequences of SEQ ID NO's: 951-1225;
f) amino acid sequences that have 3, 2, or 1 amino acid difference with at least one of the amino acid sequences of SEQ ID NO's: 951-1225;
and
CDR3 is chosen from the group consisting of:
g) the amino acid sequences of SEQ ID NO's: 1501-1775;
h) amino acid sequences that have at least 80% amino acid identity with at least one of the amino acid sequences of SEQ ID NO's: 1501-1775;
i) amino acid sequences that have 3, 2, or 1 amino acid difference with at least one of the amino acid sequences of SEQ ID NO's: 1501-1775.

142. Nanobody according to any of aspects 104 to 141, in which the CDR sequences have at least 70% amino acid identity, preferably at least 80% amino acid identity, more preferably at least 90% amino acid identity, such as 95% amino acid identity or more or even essentially 100% amino acid identity with the CDR sequences of at least one of the amino acid sequences of SEQ ID NO's: 2051-2325.

143. Nanobody according to any of aspects 104 to 1.42, which is a partially humanized Nanobody.

144. Nanobody according to any of aspects 104 to 143, which is a fully humanized Nanobody.

145. Nanobody according to any of aspects 104 to 144, that is chosen from the group consisting of SEQ ID NO's: 2051-2325 or from the group consisting of amino acid sequences that have more than 80%, preferably more than 90%, more preferably more than 95%, such as 99% or more sequence identity (as defined herein) with at least one of the amino acid sequences of SEQ ID NO's: 2051-2325.

146. Nanobody according to any of aspects 104 to 145, that is chosen from the group consisting of SEQ ID NO's: 2051-2325.

147. Nanobody directed against HER2 that cross-blocks the binding of at least one of the Nanobodies according to any of aspects 140 to 146 to HER2.

148. Nanobody directed against HER2 that is cross-blocked from binding to HER2 by at least one of the Nanobodies according to any of aspects 140 to 146.

149. Nanobody according to any of aspects 147 or 148, wherein the ability of said Nanobody to cross-block or to be cross-blocked is detected in a Biacore assay.

150. Nanobody according to any of aspects 147 to 149, wherein the ability of said Nanobody to cross-block or to be cross-blocked is detected in an ELISA assay.

151. Compound or construct, that comprises or essentially consists of one or more amino acid sequences according to any of aspects 1 to 103 and/or one or more Nanobodies according to any of aspects 104 to 150, and optionally further comprises one or more other groups, residues, moieties or binding units, optionally linked via one or more linkers.

152. Compound or construct according to aspect 151, in which said one or more other groups, residues, moieties or binding units are amino acid sequences.

153. Compound or construct according to aspect 151, in which said one or more linkers, if present, are one or more amino acid sequences.

154. Compound or construct according to any of aspects 151 to 153, in which said one or more other groups, residues, moieties or binding units are immunoglobulin sequences.

155. Compound or construct according to any of aspects 151 to 154, in which said one or more other groups, residues, moieties or binding units are chosen from the group consisting of domain antibodies, amino acid sequences that are suitable for use as a domain antibody, single domain antibodies, amino acid sequences that are suitable for use as a single domain antibody, "dAb"'s, amino acid sequences that are suitable for use as a dAb, or Nanobodies.

156. Compound or construct according to any of aspect 151 to 155, in which said one or more amino acid sequences of the invention are immunoglobulin sequences.

157. Compound or construct according to any of aspects 151 to 156, in which said one or more amino acid sequences of the invention are chosen from the group consisting of domain antibodies, amino acid sequences that are suitable for use as a domain antibody, single domain antibodies, amino acid sequences that are suitable for use as a single domain antibody, "dAb"'s, amino acid sequences that are suitable for use as a dAb, or Nanobodies.

158. Compound or construct, that comprises or essentially consists of one or more Nanobodies according to any of aspects 104 to 150 and in which said one or more other groups, residues, moieties or binding units are Nanobodies.

159. Compound or construct according to any of aspects 151 to 158, which is a multivalent construct.

160. Compound or construct according to aspect 159, that is chosen from the group consisting of SEQ ID NO's: 2326-2330 or from the group consisting of from amino acid sequences that have more than 80%, preferably more than 90%, more preferably more than 95%, such as 99% or more sequence identity (as defined herein) with at least one of the amino acid sequences of SEQ ID NO's: 2326-2330.

161. Compound or construct according to any of aspects 151 to 160, which is a multiparatopic construct.

162. Compound or construct according to aspect 161, which is a biparatopic or triparatopic construct.

163. Compound or construct according to aspect 162, which comprises at least one amino acid sequence directed against a first antigenic determinant, epitope, part or domain of HER-2 and at least one amino acid sequence directed against a second antigenic determinant, epitope, part or domain of HER-2 different from the first antigenic determinant, epitope, part or domain 164. Biparatopic compound or construct according to aspect 163, which is capable of simultaneously binding to said first antigenic determinant, epitope, part or domain of HER2 and to said second antigenic determinant, epitope, part or domain of HER2.

165. Compound or construct according to any of aspects 151 to 164, which combines two or more different modes of action each mediated by one of its binding units, wherein each binding unit binds at a different binding site of HER2.

166. Compound or construct according to any of aspects 151 to 165, which modulates, inhibits, downregulate and/or blocks two different cell signaling pathways, each mediated by one of its binding units, wherein each binding unit binds at a different binding site of HER2.

167. Compound or construct according to aspect 151 to 166, wherein said compound or construct competes with Herceptin® for binding to HER2.

168. Compound or construct according to any of aspects 151 to 167, wherein said compound or construct inhibits and/or blocks binding of Herceptin® to HER2.

169. Compound or construct according to any of aspects 151 to 168, wherein said compound or construct is directed against the Herceptin® binding site on HER2.

170. Compound or construct according to any of aspects 151 to 169, wherein said compound or construct specifically binds to domain IV of HER2.

171. Compound or construct according to any of aspects 151 to 170, wherein said compound or construct recruits immune effector cells such as macrophages and monocytes to the tumor.

172. Compound or construct according to any of aspects 151 to 171, wherein said compound or construct downregulates HER2 levels and/or downregulates HER2-mediated signalling pathways.

173. Compound or construct according to any of aspects 151 to 172, wherein said compound or construct inhibits and/or blocks metalloproteinase-mediated. HER2 ectodomain shedding.

174. Compound or construct according to any of aspects 151 to 173, wherein said compound or construct modulates HER2 or HER2 mediated signalling via the same mechanism of action as Herceptin®.

175. Compound or construct according to aspect 151 to 174, wherein said compound or construct competes with Omnitarg for binding to HER2.

176. Compound or construct according to any of aspects 151 to 175, wherein said compound or construct inhibits and/or blocks binding of Omnitarg to HER2.

177. Compound or construct according to any of aspects 151 to 176, wherein said compound or construct is directed against the Omnitarg binding site on HER2.

178. Compound or construct according to any of aspects 151 to 177, wherein said compound or construct specifically binds to domain II of HER2.

179. Compound or construct according to any of aspects 151 to 178, wherein said compound or construct inhibits and/or blocks ligand activation of an ERbB hetero-oligomer comprising HER2 and HER3, HER4 or EGFR.

180. Compound or construct according to any of aspects 151 to 179, wherein said compound or construct is directed against the Herceptin® binding site on HER2 and against the Omnitarg binding site on HER2.

181. Compound or construct according to any of aspects 151 to 180, wherein said compound or construct modulates HER2 or HER2 mediated signalling via the same mechanism of action as Omnitarg.

182. Compound or construct according to any of aspects 151 to 181, wherein said compound or construct competes with Herceptin® and Omnitarg for binding to HER2.

183. Compound or construct according to any of aspects 151 to 182, wherein said compound or construct inhibits and/or blocks binding of Herceptin® and Omnitarg to HER2.

184. Compound or construct according to any of aspects 151 to 183, which specifically binds the Omnitarg binding site on HER2 and to the Herceptin® binding site on HER2.

185. Compound or construct according to any of aspects 151 to 184, which specifically binds to domain IV and domain II of HER2.

186. Biparatopic compound or construct according to any of aspects 151 to 185, which can simultaneously bind the Omnitarg binding site on HER2 and to the Herceptin® binding site on HER2.

187. Compound or construct according to any of aspects 151 to 186, which down-regulates HER2 levels while at the same time inhibiting and/or blocking heterodimerization between ERBB receptors.

188. Compound or construct according to any of aspects 151 to 187, which combines the mode of action of Herceptin® and Omnitarg.

189. Compound or construct according to any of aspects 151 to 188, wherein said compound or construct inhibits and/or blocks tumor cell proliferation.

190. Compound or construct according to any of aspects 151 to 189, wherein said compound or construct inhibits, downregulates and/or blocks cell signalling.

191. Compound or construct according to any of aspects 151 to 190, wherein said compound or construct induces apoptosis in tumor cells.

192. Compound or construct according to any of aspects 151 to 191, wherein said compound or construct inhibits and/or blocks heterodimerization between ERBB receptors.

193. Compound or construct according to any of aspects 151 to 192, wherein said compound or construct inhibits and/or blocks tumor vascularisation.

194. Compound or construct according to any of aspects 151 to 193, wherein said compound or construct inhibits and/or blocks TNF induced signalling and/or cell proliferation.

195. Compound or construct according to any of aspects 151 to 194, wherein said compound or construct inhibits, downregulates and/or blocks ligand-mediated ErbB signalling.

196. Compound or construct according to any of aspects 151 to 195, wherein said compound or construct inhibits and/or blocks HER2 ectodomain cleavage.

197. Compound or construct according to any of aspects 151 to 196, wherein said compound or construct inhibits and/or blocks Heregulin-mediated activation of MAPK/Erk1/2.

198. Compound or construct according to any of aspects 151 to 197, wherein said compound or construct inhibits and/or blocks PI3K/Akt 199. Compound or construct according to any of aspects 151 to 198, wherein said compound or construct is linked to an Fc portion.

200. Compound or construct that comprises an Fc portion that is linked, optionally via a suitable linker or hinge region, to a pair of first amino acid sequences according to any of aspects 1 to 103 or Nanobodies according to any of aspects 104 to 150, which are linked, optionally via a suitable linker, to a pair of second amino acid sequences according to any of aspects 1 to 103 or Nanobodies according to any of aspects 104 to 150, wherein:
both of the first amino acid sequences according to any of aspects 1 to 103 or Nanobodies according to any of aspects 104 to 150 are directed against a first epitope, antigenic determinant, part, domain or subunit on HER2; and both of the second amino acid sequences according to any of aspects 1 to 103 or Nanobodies according to any of aspects 104 to 150 are directed against a second epitope, antigenic determinant, part, domain or subunit on HER2 which is different from said first epitope, antigenic determinant, part, domain or subunit.

201. Compound or construct according to any of aspects 199 or 200, wherein the first amino acid sequences according to any of aspects 1 to 103 or Nanobodies according to any of aspects 104 to 150 are directed against the Herceptin® binding site on HER-2 and/or are amino acid sequences or Nanobodies that are capable of competing with Herceptin® for binding to HER-2.

202. Compound or construct according to any of aspects 199 to 201, wherein the first amino acid sequences according to any of aspects 1 to 103 or Nanobodies according to any of aspects 104 to 150 are directed against the Omnitarg® binding site on HER-2 and/or are amino acid sequences or Nanobodies that are capable of competing with Omnitarg® for binding to HER-2.

203. Compound or construct according to any of aspects 199 to 202, wherein the first amino acid sequences according to any of aspects 1 to 103 or Nanobodies according to any of aspects 104 to 150 are directed against the Herceptin® binding site on HER-2 and/or are amino acid sequences or Nanobodies that are capable of competing with Herceptin® for binding to HER-2 and the second amino acid sequences according to any of aspects 1 to 103 or Nanobodies according to any of aspects 104 to 150 are directed against the Omnitarg® binding site on HER-2 and/or are amino acid sequences or Nanobodies that are capable of competing with Omnitarg® for binding to HER-2 (or visa versa).

204. Compound or construct according to any of aspects 151 to 203, that comprises or that is chosen from the group consisting of SEQ ID NO's: 2336-2390 or from the group consisting of from amino acid sequences that have more than 80%, preferably more than 90%, more preferably more than 95%, such as 99% or more sequence identity (as defined herein) with at least one of the amino acid sequences of SEQ ID NO's: 2336-2390.

205. Compound or construct according to any of aspects 151 to 204, which is a multispecific construct.

206. Compound or construct according to any of aspects 151 to 205, which has an increased half-life, compared to the corresponding amino acid sequence according to any of aspects 1 to 103 per se or Nanobody according to any of aspects 104 to 150 per se, respectively.

207. Compound or construct according to any of aspects 151 to 206, in which said one or more other groups, residues, moieties or binding units provide the compound or construct with increased half-life, compared to the corresponding amino acid sequence according to any of aspects 1 to 103 per se or Nanobody according to any of aspects 104 to 150 per se, respectively.

208. Compound or construct according to aspect 207, in which said one or more other groups, residues, moieties or binding units that provide the compound or construct with increased half-life is chosen from the group consisting of serum proteins or fragments thereof, binding units that can bind to serum proteins, an Fc portion, and small proteins or peptides that can bind to serum proteins.

209. Compound or construct according to aspect 207, in which said one or more other groups, residues, moieties or binding units that provide the compound or construct with increased half-life is chosen from the group consisting of human serum albumin or fragments thereof.

210. Compound or construct according to aspect 207, in which said one or more other groups, residues, moieties or binding units that provides the compound or construct with increased half-life are chosen from the group consisting of binding units that can bind to serum albumin (such as human serum albumin) or a serum immunoglobulin (such as IgG).

211. Compound or construct according to aspect 207, in which said one or more other groups, residues, moieties or binding units that provides the compound or construct with increased half-life are chosen from the group consisting of domain antibodies, amino acid sequences that are suitable for use as a domain antibody, single domain antibodies, amino acid sequences that are suitable for use as a single domain antibody, "dAb'"s, amino acid sequences that are suitable for use as a dAb, or Nanobodies that can bind to serum albumin (such as human serum albumin) or a serum immunoglobulin (such as IgG).

212. Compound or construct according to aspect 207, in which said one or more other groups, residues, moieties or binding units that provides the compound or construct with increased half-life is a Nanobody that can bind to serum albumin (such as human serum albumin) or a serum immunoglobulin (such as IgG).

213. Compound or construct according to any of aspects 206 to 212, that has a serum half-life that is at least 1.5 times, preferably at least 2 times, such as at least 5 times, for example at least 10 times or more than 20 times, greater than the half-life of the corresponding amino acid sequence according to any of aspects 1 to 103 per se or Nanobody according to any of aspects 104 to 150 per se, respectively.

214. Compound or construct according to any of aspects 206 to 213, that has a serum half-life that is increased with more than 1 hours, preferably more than 2 hours, more preferably more than 6 hours, such as more than 12 hours, or even more than 24, 48 or 72 hours, compared to the corresponding amino acid sequence according to any of aspects 1 to 103 per se or Nanobody according to any of aspects 104 to 150 per se, respectively.

215. Compound or construct according to any of aspects 206 to 214, that has a serum half-life in human of at least about 12 hours, preferably at least 24 hours, more preferably at least 48 hours, even more preferably at least 72 hours or more; for example, of at least 5 days (such as about 5 to 10 days), preferably at least 9 days (such as about 9 to 14 days), more preferably at least about 10 days (such as about 10 to 15 days), or at least about 11 days (such as about 11 to 16 days), more preferably at least about 12 days (such as about 12 to 18 days or more), or more than 14 days (such as about 14 to 19 days).

216. Compound or construct according to any of aspects 151 to 215, in which said one or more other groups, residues, moieties or binding units are one or more constant domains.

217. Compound or construct according to aspect 216, wherein said one or more constant domains are two constant domains that can be used as part of/to form an Fc portion.

218. Compound or construct according to any of aspects 216 or 217, wherein said one or more constant domains are three constant domains that can be used as part of/to form an Fc portion.

219. Compound or construct according to any of aspects 216 to 218, wherein said one or more constant domains confer one or more effector functions to the compound or construct.

220. Compound or construct according to any of aspects 216 to 219, wherein said one or more constant domains confer the ability to bind to one or more Fc receptors.
221. Compound or construct according to any of aspects 216 to 220, in which said one or more amino acid sequences or Nanobodies are linked to the Fc portion via a linker or hinge region.
222. Compound or construct according to any of aspects 216 to 221, wherein said one or more constant domains are from IgG (e.g. from IgG1, IgG2, IgG3 or IgG4).
223. Compound or construct according to any of aspects 216 to 221, wherein said one or more constant domains are from human Ig such as IgA, IgD or IgM.
224. Compound or construct according to any of aspects 216 to 221, wherein said one or more constant domains are from IgE.
225. Compound or construct that comprises two amino acids according to any of aspects 1 to 103 or Nanobodies according to any of aspects 104 to 150 and an Fc portion that is capable of effecting one or more IgE-mediated immune responses and/or that is capable of binding to either the FcεRI receptor and/or the FcεRII receptor.
226. Compound or construct according to aspect 225, comprising two polypeptide chains, in which each polypeptide chain comprises at least one amino acid sequence according to any of aspects 1 to 103 or at least one Nanobody according to any of aspects 104 to 150 that is linked, optionally via a suitable linker or hinge region, to one or more constant domains, in which the constant domains from the first polypeptide chain and the second polypeptide chains together form an Fc portion that is capable of effecting one or more IgE-mediated immune responses and/or that is capable of binding to either the FcεRI receptor and/or the FcεRII receptor.
227. Compound or construct according to any of aspects 224 to 226, in which the Fc portion is capable of binding to FcεRI with an affinity (expressed as the $K_a$ value) better than $10^6$ M$^{-1}$, preferably better than $10^8$ M$^{-1}$, more preferably better than $10^9$ M$^{-1}$, such as with a $K_a$ value of about $10^{10}$ M$^{-1}$ or $10^{11}$ M$^{-1}$.
228. Compound or construct according to any of aspects 224 to 227, in which the Fc portion is capable of binding to FcεRII with an affinity (expressed as the $K_a$ value) better than $10^6$ M$^{-1}$, preferably better than $10^7$ M$^{-1}$, such as with a $K_a$ value of about $10^8$ M$^{-1}$.
229. Compound or construct according to any of aspects 224 to 228, in which the Fc portion comprises at least one or more parts, fragments, amino acid stretches or domains of the Fc portion of IgE.
230. Compound or construct according to any of aspects 224 to 229, in which the Fc portion comprises at least one or more of those parts, fragments, amino acid stretches or domains of the Fc portion of IgE that allow IgE to bind to its receptors.
231. Compound or construct according to any of aspects 224 to 230, in which the Fc portion at least comprises $C_\epsilon 4$ (or a suitable part of fragment thereof), and optionally also comprises $C_\epsilon 3$ (or a suitable part of fragment thereof) and/or $C_\epsilon 2$ (or a suitable part of fragment thereof).
232. Compound or construct according to any of aspects 224 to 231, in which the Fc portion essentially consist of three constant domains.
233. Compound or construct according to any of aspects 224 to 232, in which the parts, fragments, amino acid stretches or domains that make up the IgE-derived Fc portion are preferably all or essentially all derived from human Fc portions.
234. Compound or construct according to any of aspects 224 to 233, in which the IgE-derived Fc portion is from human IgE.
235. Monovalent construct, comprising or essentially consisting of one amino acid sequence according to any of aspects 1 to 103 and/or one Nanobody according to any of aspects 104 to 150.
236. Monovalent construct according to aspect 235, in which said amino acid sequence is chosen from the group consisting of domain antibodies, amino acid sequences that are suitable for use as a domain antibody, single domain antibodies, amino acid sequences that are suitable for use as a single domain antibody, "dAb"'s, amino acid sequences that are suitable for use as a dAb, or Nanobodies.
237. Monovalent construct, comprising or essentially consisting of one Nanobody according to any of aspects 104 to 150.
238. Monovalent construct, that is chosen from the group consisting of SEQ ID NO's: 2051-2325 or from the group consisting of amino acid sequences that have more than 80%, preferably more than 90%, more preferably more than 95%, such as 99% or more sequence identity (as defined herein) with at least one of the amino acid sequences of SEQ ID NO's: 2051-2325.
239. Use of a monovalent construct according to any of aspects 235 to 238, in preparing a multivalent compound or construct according to any of aspects 151 to 234.
240. Use of a monovalent construct according to aspect 239, in preparing a multiparatopic construct such as a biparatopic construct.
241. Use of a monovalent construct according to any of aspects 239 or 240, wherein the monovalent construct is used as a binding domain or binding unit in preparing a multivalent construct comprising two or more binding units.
242. Use of a monovalent construct according to any of aspects 239 to 241, in preparing a multivalent construct that exhibits intramolecular binding compared to intermolecular binding.
243. Use of a monovalent construct according to any of aspects 239 to 242, as a binding domain or binding unit in preparing a multivalent construct, wherein the binding domains or binding units are linked via a linker such that the multivalent construct preferably exhibits intramolecular binding compared to intermolecular binding.
244. Use of a monovalent construct according to any of aspects 239 to 243, wherein the monovalent construct is directed against the Omnitarg binding site on HER2 and/or is capable of competing with Omnitarg for binding to HER-2.
245. Use of a monovalent construct according to any of aspects 239 to 244, wherein the monovalent construct is directed against domain II of HER2.
246. Use of a monovalent construct according to any of aspects 239 to 245, wherein the monovalent construct is directed against the middle of domain II of HER2.
247. Use of a monovalent construct according to any of aspects 239 to 243, wherein the monovalent construct is directed against the Herceptin® binding site on HER2.
248. Use of a monovalent construct according to any of aspects 239 to 243 or 247, wherein the monovalent construct is directed against domain IV of HER2.
249. Use of a monovalent construct according to any of aspects 239 to 243 or 247 to 248, wherein the monovalent construct is directed against the C-terminus of domain IV of HER2.

250. Use of two monovalent constructs according to any of aspects 239 to 249, wherein a first monovalent construct is directed against the Omnitarg binding site on HER2 (and in particular against domain II of HER2, and more in particular against the middle of domain II of HER2) and/or is capable of competing with Omnitarg for binding to HER-2 and wherein the second monovalent construct is directed against the Herceptin® binding site on HER2 (and in particular against domain IV of HER2, and more in particular against the C-terminus of domain IV of HER2) and/or is capable of competing with Herceptin® for binding to HER-2.

251. Nucleic acid or nucleotide sequence, that encodes an amino acid sequence according to any of aspects 1 to 103, a Nanobody according to any of aspects 104 to 150, a compound or construct according to any of aspects 151 to 234 that is such that it can be obtained by expression of a nucleic acid or nucleotide sequence encoding the same, or a monovalent construct according to any of aspects 235 to 238.

252. Nucleic acid or nucleotide sequence according to aspect 251, that is in the form of a genetic construct.

253. Use of a nucleic acid or nucleotide sequence according to aspect 251, that encodes a monovalent construct according to any of aspects 235 to 238, for the preparation of a genetic construct that encodes a multivalent construct according to any of aspects 151 to 234.

254. Use of a nucleic acid or nucleotide sequence according to aspect 253, wherein the genetic construct encodes a multiparatopic (such as a biparatopic) construct.

255. Host or host cell that expresses, or that under suitable circumstances is capable of expressing, an amino acid sequence according to any of aspects 1 to 103, a Nanobody according to any of aspects 104 to 150, a compound or construct according to any of aspects 151 to 234 that is such that it can be obtained by expression of a nucleic acid or nucleotide sequence encoding the same, or a monovalent construct according to any of aspects 235 to 238; and/or that comprises a nucleic acid or nucleotide sequence according to aspect 251, or a genetic construct according to aspect 252.

256. Method for producing an amino acid sequence according to any of aspects 1 to 103, a Nanobody according to any of aspects 104 to 150, a compound or construct according to any of aspects 151 to 234 that is such that it can be obtained by expression of a nucleic acid or nucleotide sequence encoding the same, or a monovalent construct according to any of aspects 235 to 238, said method at least comprising the steps of:
a) expressing, in a suitable host cell or host organism or in another suitable expression system, a nucleic acid or nucleotide sequence according to aspect 251, or a genetic construct according to aspect 252
optionally followed by:
b) isolating and/or purifying the amino acid sequence according to any of aspects 1 to 103, the Nanobody according to any of aspects 104 to 150, the compound or construct according to any of aspects 151 to 234 that is such that it can be obtained by expression of a nucleic acid or nucleotide sequence encoding the same, or the monovalent construct according to any of aspects 235 to 238 thus obtained.

257. Method for producing an amino acid sequence according to any of aspects 1 to 103, a Nanobody according to any of aspects 104 to 150, a compound or construct according to any of aspects 151 to 234 that is such that it can be obtained by expression of a nucleic acid or nucleotide sequence encoding the same, or a monovalent construct according to any of aspects 235 to 238, said method at least comprising the steps of:
a) cultivating and/or maintaining a host or host cell according to aspect 255 under conditions that are such that said host or host cell expresses and/or produces at least one amino acid sequence according to any of aspects 1 to 103, Nanobody according to any of aspects 104 to 150, compound or construct according to any of aspects 151 to 234 that is such that it can be obtained by expression of a nucleic acid or nucleotide sequence encoding the same, or a monovalent construct according to any of aspects 235 to 238,
optionally followed by:
b) isolating and/or purifying the amino acid sequence according to any of aspects 1 to 103, the Nanobody according to any of aspects 104 to 150, the compound or construct according to any of aspects 151 to 234 that is such that it can be obtained by expression of a nucleic acid or nucleotide sequence encoding the same, or the monovalent construct according to any of aspects 235 to 238 thus obtained.

258. Method for preparing and/or generating a multiparatopic (such as e.g. biparatopic, triparatopic, etc.) construct according to any of aspects 161 to 204, said method comprising at least the steps of:
a) providing a nucleic acid sequence according to aspect 251, encoding a first HER2 binding amino acid sequence, fused to a set, collection or library of nucleic acid sequences encoding amino acid sequences;
b) screening said set, collection or library of nucleic acid sequences for nucleic acid sequences that encode a second amino acid sequence that can bind to and/or has affinity for an antigenic determinant on HER2 different from the antigenic determinant recognized by the first HER2 binding amino acid sequence;
and
c) isolating the nucleic acid sequence encoding an HER2 binding amino acid sequence fused to the nucleic acid sequence obtained in b), followed by expressing the encoded construct.

259. Method for preparing and/or generating a biparatopic construct according to any of aspects 161 to 204, said method comprising at least the steps of:
a) providing a set, collection or library of nucleic acid sequences, in which each nucleic acid sequence in said set, collection or library encodes a fusion protein that comprises a first amino acid sequence that can bind to and/or has affinity for a first antigenic determinant, part, domain or epitope on HER2 that is fused (optionally via a linker sequence) to a second amino acid sequence, in which essentially each second amino acid sequence (or most of these) is a different member of a set, collection or library of different amino acid sequences;
b) screening said set, collection or library of nucleic acid sequences for nucleic acid sequences that encode an amino acid sequence that can bind to and/or has affinity for a second antigenic determinant, part, domain or epitope on HER2 different from the first antigenic determinant, part, domain or epitope on HER-2;
and
c) isolating the nucleic acid sequences that encode an amino acid sequence that can bind to and/or has affinity for a second antigenic determinant, part, domain or epitope on HER2 different from the first antigenic determinant, part, domain or epitope on HER-2, obtained in b), optionally followed by expressing the encoded amino acid sequence.

260. Method according to aspect 259, wherein the first amino acid is also encoded by a set, collection or library of nucleic acid sequences and wherein, in step b), said set, collection or library of nucleic acid sequences is screened for nucleic acid sequences that encode an amino acid sequence that can bind to and/or has affinity for the first antigenic determinant, part, domain or epitope on HER2.

261. Method according to aspect 260, wherein the screening in step b) is performed in a single step.

262. Method according to aspect 260, wherein the screening in step b) is performed in subsequent steps.

263. Method according to any of aspects 258 to 262, wherein the first amino acid sequence used in step a) is preferably such that (i) it can bind to and/or has affinity for the Herceptin® binding site on HER2 (and in particular domain IV of HER2, more in particular the C-terminus of domain IV of HER2) and/or (ii) competes with Herceptin® for binding to HER-2.

264. Method according to any of aspects 258 to 263, wherein in step b), the set, collection or library of nucleic acid sequences is screened for nucleic acid sequences that encode (i) an amino acid sequence that can bind to and/or has affinity for the Omnitarg binding site on HER2 (and in particular domain TI of HER2, more in particular the middle of domain II of HER2) and/or (ii) an amino acid sequence that can compete with Omnitarg or Omnitarg Fab for binding to HER-2.

265. Method according to any of aspects 258 to 264, wherein the first amino acid sequence used in step a) is preferably such that (i) it can bind to and/or has affinity for the Omnitarg binding site on HER2 (and in particular domain II of HER2, more in particular the middle of domain H of HER2) and/or (ii) competes with Omnitarg for binding to HER-2.

266. Method according to any of aspects 258 to 265, wherein in step b), the set, collection or library of nucleic acid sequences is screened for nucleic acid sequences that encode (i) an amino acid sequence that can bind to and/or has affinity for the Herceptin® binding site on HER2 (and in particular domain IV of HER2, more in particular the C-terminus of domain IV of HER2) and/or (ii) an amino acid sequence that can compete with Herceptin® for binding to HER-2.

267. Method according to any of aspects 258 to 266, wherein in step b), the set, collection or library of nucleic acid sequences is screened for nucleic acid sequences that both (i) encode an amino acid sequence that can bind to and/or has affinity for the Omnitarg binding site on HER2 (and in particular domain II of HER2, more in particular the middle of domain II of HER2) and/or that can compete with Omnitarg or Omnitarg Fab for binding to HER-2 and that also (ii) encode an amino acid sequence that can bind to and/or has affinity for the Herceptin® binding site on HER2 (and in particular domain IV of HER2, more in particular the C-terminus of domain IV of HER2) and/or that can compete with Herceptin® for binding to HER-2.

268. Method according to aspect 267, wherein the screening in step b) is performed in a single step.

269. Method according to aspect 267, wherein the screening in step b) is performed in a subsequent steps.

270. Method according to any of aspects 258 to 269, wherein the screening in step b) is performed in the presence of Herceptin® and/or Omnitarg.

271. Method for screen for suitable and/or optimal linker lengths for linking a first and a second amino acid sequence in a biparatopic constructs according to any of aspects 161 to 204, wherein said method comprises at least the steps of:
d) providing a set, collection or library of nucleic acid sequences, in which each nucleic acid sequence in said set, collection or library encodes a fusion protein that comprises a first amino acid sequence that can bind to and/or has affinity for a first antigenic determinant, part, domain or epitope on HER2 that is fused via a linker sequence to a second amino acid sequence that has can bind to and/or has affinity for a second antigenic determinant, part, domain or epitope on HER2 (which may be the same or different as the first antigenic determinant, part, domain or epitope on HER2), in which essentially each nucleic acid sequence (or most of these) encodes a fusion protein with a different linker sequence so as to provide a set, collection or library encoding different fusion proteins;
e) screening said set, collection or library of nucleic acid sequences for nucleic acid sequences that encode an amino acid sequence that can bind to and/or has affinity for the first and second antigenic determinant, part, domain or epitope on HER2; and
f) isolating the nucleic acid sequences that encode an amino acid sequence that can bind to and/or has affinity for the first and second antigenic determinant, part, domain or epitope on HER2, optionally followed by expressing the encoded amino acid sequence.

272. Method according to aspect 271, wherein the first amino acid sequence is an amino acid sequence that can bind to and/or has affinity for the Omnitarg binding site on HER2 (and may in particular domain II of HER2, more in particular the middle of domain II of HER2) and/or that can compete with Omnitarg or Omnitarg Fab.

273. Method according to aspect 271, wherein the second amino acid sequence is an amino acid sequence that can bind to and/or has affinity for the Herceptin® binding site on HER2 (and in particular domain IV of HER2, more in particular the C-terminus of domain IV of HER2) and/or that can compete with Herceptin® for binding to HER-2.

274. Method according to aspect 271, wherein the first amino acid sequence is an amino acid sequence that can bind to and/or has affinity for the Omnitarg binding site on HER2 (and may in particular domain. II of HER2, more in particular the middle of domain II of HER2) and/or that can compete with Omnitarg or Omnitarg Fab and wherein the second amino acid sequence is an amino acid sequence that can bind to and/or has affinity for the Herceptin® binding site on HER2 (and in particular domain IV of HER2, more in particular the C-terminus of domain IV of HER2) and/or that can compete with Herceptin® for binding to HER-2.

275. Method according to any of aspects 271 to 274, wherein the screening in step b) is performed in a single step.

276. Method according to any of aspects 271 to 274, wherein the screening in step b) is performed in subsequent steps.

277. Method according to any of aspects 271 to 276, wherein the screening in step b) is performed in the presence of Herceptin® and/or Omnitarg.

278. Method for preparing and/or generating biparatopic constructs according to any of aspects 161 to 204, said method comprising at least the steps of:
a) providing a set, collection or library of nucleic acid sequences encoding amino acid sequences;
b) screening said set, collection or library of nucleic acid sequences for a set, collection or library of nucleic acid sequences that encode an amino acid sequence that can bind to and/or has affinity for HER2;

c) ligating said set, collection or library of nucleic acid sequences that encode an amino acid sequence that can bind to and/or has affinity for HER2 to another nucleic acid sequence that encodes an amino acid sequence that can bind to and/or has affinity for HER2 (e.g. a nucleic acid sequence that encodes an amino acid sequence that competes with Herceptin® for binding HER2); and d) from the set, collection or library of nucleic acid sequences obtained in c), isolating the nucleic acid sequences encoding a biparatopic amino acid sequence that can bind to and/or has affinity for HER2 (and e.g. further selecting for nucleic acid sequences that encode a biparatopic amino acid sequence that antagonizes with higher potency compared to the monovalent amino acid sequences), followed by expressing the encoded amino acid sequence.

279. Method for preparing and/or generating biparatopic constructs according to any of aspects, said method comprising at least the steps of:

a) providing a first set, collection or library of nucleic acid sequences encoding amino acid sequences;

b) screening said first set, collection or library of nucleic acid sequences for a nucleic acid sequence that encodes an amino acid sequence that can bind to and/or has affinity for a first antigenic determinant, part, domain or epitope on HER2;

c) ligating the nucleic acid sequence encoding said amino acid sequence that can bind to and/or has affinity for a first antigenic determinant, part, domain or epitope on HER2 obtained in b) to another set, collection or library of nucleic acid sequences encoding amino acid sequences to obtain a set, collection or library of nucleic acid sequences that encode fusion proteins;

d) screening said set, collection or library of nucleic acid sequences obtained in step c) for a nucleic acid sequence that encodes an amino acid sequence that can bind to and has affinity for a second antigenic determinant, part, domain or epitope on HER2 which is the same or different from the first antigenic determinant, part, domain or epitope on HER-2; and e) isolating the nucleic acid sequence that encodes an amino acid sequence that can bind to and/or has affinity for the first and second antigenic determinant, part, domain or epitope on HER2, optionally followed by expressing the encoded amino acid sequence.

280. Method according to aspect 279, wherein in step b), the set, collection or library of nucleic acid sequences is screened for nucleic acid sequences that encode a first amino acid sequence that (i) can bind to and/or has affinity for the Herceptin® binding site on HER2 (and in particular domain IV of HER2, more in particular the C-terminus of domain IV of HER2) and/or (ii) competes with Herceptin® for binding to HER-2.

281. Method according to aspect 279, wherein in step d), the set, collection or library of nucleic acid sequences is screened for nucleic acid sequences that encode a second amino acid sequence that (i) can bind to and/or has affinity for the Omnitarg binding site on HER2 (and in particular domain. II of HER2, more in particular the middle of domain II of HER2) and/or (ii) that can compete with Omnitarg or Omnitarg Fab for binding to HER-2.

282. Method according to aspect 279, wherein in step b), the set, collection or library of nucleic acid sequences is screened nucleic acid sequences that encode a first amino acid sequence that (i) can bind to and/or has affinity for the Herceptin® binding site on HER2 (and in particular domain IV of HER2, more in particular the C-terminus of domain IV of HER2) and/or (ii) competes with Herceptin® for binding to HER-2 and wherein in step d), the set, collection or library of nucleic acid sequences is screened for nucleic acid sequences that encode a second amino acid sequence that (i) can bind to and/or has affinity for the Omnitarg binding site on HER2 (and in particular domain II of HER2, more in particular the middle of domain II of HER2) and/or (ii) that can compete with Omnitarg or Omnitarg Fab for binding to HER-2 (or visa versa).

283. Method according to aspect 279, wherein in step b), the set, collection or library of nucleic acid sequences is screened nucleic acid sequences that encode a first amino acid sequence that (i) can bind to and/or has affinity for the Omnitarg binding site on HER2 (and in particular domain II of HER2, more in particular the middle of domain II of HER2) and/or (ii) competes with Omnitarg for binding to HER-2.

284. Method according to aspect 279, wherein in step d), the set, collection or library of nucleic acid sequences is screened for nucleic acid sequences that encode a second amino acid sequence that (i) can bind to and/or has affinity for the Herceptin® binding site on HER2 (and in particular domain IV of HER2, more in particular the C-terminus of domain IV of HER2) and/or (ii) that can compete with Herceptin® for binding to HER-2.

285. Method according to aspect 279, wherein in step b), the set, collection or library of nucleic acid sequences is screened nucleic acid sequences that encode a first amino acid sequence that (i) can bind to and/or has affinity for the Omnitarg binding site on HER2 (and in particular domain H of HER2, more in particular the middle of domain II of HER2) and/or (ii) competes with Omnitarg for binding to HER-2 and wherein in step d), the set, collection or library of nucleic acid sequences is screened for nucleic acid sequences that encode a second amino acid sequence that (i) can bind to and/or has affinity for the Herceptin® binding site on HER2 (and in particular domain IV of HER2, more in particular the C-terminus of domain. IV of HER2) and/or (ii) that can compete with Herceptin® for binding to HER-2.

286. Method according to aspect 285, wherein the screening in steps b) and/or d) is performed in the presence of Herceptin® and/or Omnitarg.

287. Method for preparing and/or generating a biparatopic constructs according to any of aspects 161 to 204, said method comprising at least the steps of linking two or more monovalent amino acid sequences or monovalent construct according to any of aspects 235 to 238 and for example one or more linkers.

288. Method according to aspect 287, comprising the steps of:

a) linking two or more nucleic acid sequences according to aspect 251, encoding a monovalent construct according to any of aspects 235 to 238 (and also for example nucleic acids encoding one or more linkers and further one or more further elements of genetic constructs known per se) to obtain a genetic construct according to aspect 252;

b) expressing, in a suitable host cell or host organism or in another suitable expression system, the genetic construct obtained in a)

optionally followed by:
c) isolating and/or purifying the biparatopic constructs according to any of aspects 161 to 204 thus obtained.
289. Composition, comprising at least one amino acid sequence according to any of aspects 1 to 103, Nanobody according to any of aspects 104 to 150, compound or construct according to any of aspects 151 to 234, monovalent construct according to any of aspects 235 to 238, or nucleic acid or nucleotide sequence according to aspects 251 to 252.
290. Composition according to aspect 289, which is a pharmaceutical composition.
291. Composition according to aspect 289, which is a pharmaceutical composition, that further comprises at least one pharmaceutically acceptable carrier, diluent or excipient and/or adjuvant, and that optionally comprises one or more further pharmaceutically active polypeptides and/or compounds.
292. Method for the prevention and/or treatment of at least one cancer and/or tumor, said method comprising administering, to a subject in need thereof, a pharmaceutically active amount of at least one amino acid sequence according to any of aspects 1 to 103, Nanobody according to any of aspects 104 to 150, compound or construct according to any of aspects 151 to 234, monovalent construct according to any of aspects 235 to 238, or composition according to aspect 290 or 291.
293. Method for the prevention and/or treatment of at least one disease or disorder that is associated with HER2, with its biological or pharmacological activity, and/or with the biological pathways or signalling in which HER2 is involved, said method comprising administering, to a subject in need thereof, a pharmaceutically active amount of at least one amino acid sequence according to any of aspects 1 to 103, Nanobody according to any of aspects 104 to 150, compound or construct according to any of aspects 151 to 234, monovalent construct according to any of aspects 235 to 238, or composition according to aspect 290 or 291.
294. Method for the prevention and/or treatment of at least one disease or disorder that can be prevented and/or treated by administering, to a subject in need thereof, an amino acid sequence according to any of aspects 1 to 103, a Nanobody according to any of aspects 104 to 150, a compound or construct according to any of aspects 151 to 234, or a monovalent construct according to any of aspects 235 to 238, said method comprising administering, to a subject in need thereof, a pharmaceutically active amount of at least one amino acid sequence according to any of aspects 1 to 103, Nanobody according to any of aspects 104 to 150, compound or construct according to any of aspects 151 to 234, monovalent construct according to any of aspects 235 to 238, or composition according to aspect 290 or 291.
295. Method for immunotherapy, said method comprising administering, to a subject in need thereof, a pharmaceutically active amount of at least one amino acid sequence according to any of aspects 1 to 103, Nanobody according to any of aspects 104 to 150, compound or construct according to any of aspects 151 to 234, monovalent construct according to any of aspects 235 to 238, or composition according to aspect 290 or 291.
296. Use of an amino acid sequence according to any of aspects 1 to 103, a Nanobody according to any of aspects 104 to 150, a compound or construct according to any of aspects 151 to 234, or a monovalent construct according to any of aspects 235 to 238 in the preparation of a pharmaceutical composition for prevention and/or treatment of at least one cancer and/or tumor; and/or for use in one or more of the methods according to aspects 292 to 295.
297. An amino acid sequence according to any of aspects 1 to 103, a Nanobody according to any of aspects 104 to 150, a compound or construct according to any of aspects 151 to 234, or a monovalent construct according to any of aspects 235 to 238 for use in the prevention and/or treatment of at least one cancer and/or tumor; and/or for use in one or more of the methods according to aspects 292 to 295.
298. Part or fragment of an amino acid sequence according to any of aspects 1 to 103, or of a Nanobody according to any of aspects 104 to 150.
299. Part or fragment according to aspect 298, that can specifically bind to HER2.
300. Part or fragment according to aspect 299, wherein said part or fragment competes with Herceptin® for binding to HER2.
301. Part of fragment according to any of aspects 299 or 300, wherein said part or fragment inhibits and/or blocks binding of Herceptin® to HER2.
302. Part or fragment according to any of aspects 299 to 301, wherein said part or fragment is directed against the Herceptin® binding site on HER2.
303. Part of fragment according to any of aspects 299 to 302, wherein said part or fragment specifically binds to domain IV of HER2.
304. Part of fragment according to aspect 299, wherein said part or fragment competes with Omnitarg for binding to HER2.
305. Part of fragment according to any of aspects 299 or 304, wherein said part or fragment inhibits and/or blocks binding of Omnitarg to HER2.
306. Part of fragment according to any of aspects 304 or 305, wherein said part or fragment is directed against the Omnitarg binding site on HER2.
307. Part of fragment according to any of aspects 304 to 306, wherein said part or fragment specifically binds to domain II of HER2.
308. Part of fragment according to any of aspects 299 to 307, wherein said part or fragment competes with Herceptin® and Omnitarg for binding to HER2.
309. Part of fragment according to any of aspects 299 to 308, wherein said part or fragment inhibits and/or blocks binding of Herceptin® and Omnitarg to HER2.
310. Part of fragment according to any of aspects 299 to 309, wherein said part or fragment inhibits and/or blocks tumor cell proliferation.
311. Part of fragment according to any of aspects 299 to 310, wherein said part or fragment inhibits, downregulates and/or blocks cell signalling.
312. Part of fragment according to any of aspects 299 to 311, wherein said part or fragment induces apoptosis in tumor cells.
313. Part of fragment according to any of aspects 299 to 312, wherein said part or fragment inhibits and/or blocks heterodimerization between ERBB receptors.
314. Part of fragment according to any of aspects 299 to 313, wherein said part or fragment inhibits and/or blocks ligand activation of an ERbB hetero-oligomer comprising HER2 and HER3, HER4 or EGFR.
315. Part of fragment according to any of aspects 299 to 314, wherein said part or fragment inhibits and/or blocks tumor vascularisation.
316. Part of fragment according to any of aspects 299 to 315, wherein said part or fragment recruits immune effector cells such as macrophages and monocytes to the tumor.

317. Part of fragment according to any of aspects 299 to 316, wherein said part or fragment inhibits and/or blocks TNF induced signalling and/or cell proliferation.
318. Part of fragment according to any of aspects 299 to 317, wherein said part or fragment downregulates HER2 levels and/or downregulates HER2-mediated signalling pathways.
319. Part of fragment according to any of aspects 299 to 318, wherein said part or fragment inhibits and/or blocks metalloproteinase-mediated HER2 ectodomain shedding.
320. Part of fragment according to any of aspects 299 to 319, wherein said part or fragment inhibits, downregulates and/or blocks ligand-mediated ErbB signalling.
321. Part of fragment according to any of aspects 299 to 320, wherein said part or fragment inhibits and/or blocks HER2 ectodomain cleavage.
322. Part of fragment according to any of aspects 299 to 321, wherein said part or fragment inhibits and/or blocks Heregulin-mediated activation of MAPK/Erk1/2.
323. Part of fragment according to any of aspects 299 to 322, wherein said part or fragment inhibits and/or blocks PI3K/Akt signalling.
324. Part of fragment according to any of aspects 299 to 323, wherein said part or fragment modulates HER2 or HER2 mediated signalling via the same mechanism of action as Herceptin®.
325. Part of fragment according to any of aspects 299 to 324, wherein said part or fragment modulates HER2 or HER2 mediated signalling via the same mechanism of action as Omnitarg.
326. Part of fragment according to any of aspects 299 to 325, that can specifically bind to HER2 with a dissociation constant ($K_D$) of $10^{-5}$ to $10^{-12}$ moles/litre or less, and preferably $10^{-7}$ to $10^{-12}$ moles/litre or less and more preferably $10^{-8}$ to $10^{-12}$ moles/litre.
327. Part or fragment according to any of aspects 299 to 326, that can specifically bind to HER2 with a rate of association ($k_{on}$-rate) of between $10^2$ $M^{-1}$ $s^{-1}$ to about $10^7$ $M^{-1}$ $s^{-1}$, preferably between $10^3$ $M^{-1}$ $s^{-1}$ and $10^7$ $M^{-1}$ $s^{-1}$, more preferably between $10^4$ $M^{-1}$ $s^{-1}$ and $10^7$ $M^{-1}$ $s^{-1}$, such as between $10^5$ $M^{-1}$ $s^{-1}$ and $10^7$ $M^{-1}$ $s^{-1}$.
328. Part or fragment according to any of aspects 299 to 327, that can specifically bind to HER2 with a rate of dissociation ($k_{off}$ rate) between 1 $s^{-1}$ and $10^{-6}$ $s^{-1}$ preferably between $10^{-2}$ $s^{-1}$ and $10^{-6}$ $s^{-1}$, more preferably between $10^{-3}$ $s^{-1}$ and $10^{-6}$ $s^{-1}$, such as between $10^{-4}$ $s^{-1}$ and $10^{-6}$ $s^{-1}$.
329. Compound or construct, that comprises or essentially consists of one or more parts or fragments according to any of aspects 299 to 328, and optionally further comprises one or more other groups, residues, moieties or binding units, optionally linked via one or more linkers.
330. Compound or construct according to aspect 329, in which said one or more other groups, residues, moieties or binding units are amino acid sequences.
331. Compound or construct according to aspect 329, in which said one or more linkers, if present, are one or more amino acid sequences.
332. Nucleic acid or nucleotide sequence, that encodes a part or fragment according to any of aspects 299 to 328 or a compound or construct according to any of aspects 329 to 331 that is such that it can be obtained by expression of a nucleic acid or nucleotide sequence encoding the same.
333. Composition, comprising at least one part or fragment according to any of aspects 299 to 328, compound or construct according to any of aspects 329 to 331, or nucleic acid or nucleotide sequence according to aspect 332.
334. Derivative of an amino acid sequence according to any of aspects 1 to 103, or of a Nanobody according to any of aspects 104 to 150.
335. Derivative according to aspect 334, that can specifically bind to HER2.
336. Derivative according to aspect 335, wherein said derivative competes with Herceptin® for binding to HER2.
337. Derivative according to any of aspects 335 or 336, wherein said derivative inhibits and/or blocks binding of Herceptin® to HER2.
338. Derivative according to any of aspects 335 to 337, wherein said derivative is directed against the Herceptin® binding site on HER2.
339. Derivative according to any of aspects 335 to 338, wherein said derivative specifically binds to domain IV of HER2.
340. Derivative according to aspect 335, wherein said derivative competes with Omnitarg for binding to HER2.
341. Derivative according to any of aspects 335 or 340, wherein said derivative inhibits and/or blocks binding of Omnitarg to HER2.
342. Derivative according to any of aspects 340 or 341, wherein said derivative is directed against the Omnitarg binding site on HER2.
343. Derivative according to any of aspects 340 to 342, wherein said derivative specifically binds to domain II of HER2.
344. Derivative according to any of aspects 335 to 343, wherein said derivative competes with Herceptin® and Omnitarg for binding to HER2.
345. Derivative according to any of aspects 335 to 344, wherein said derivative inhibits and/or blocks binding of Herceptin® and Omnitarg to HER2.
346. Derivative according to any of aspects 335 to 345, wherein said derivative inhibits and/or blocks tumor cell proliferation.
347. Derivative according to any of aspects 335 to 346, wherein said derivative inhibits, downregulates and/or blocks cell signalling.
348. Derivative according to any of aspects 335 to 347, wherein said derivative induces apoptosis in tumor cells.
349. Derivative according to any of aspects 335 to 348, wherein said derivative inhibits and/or blocks heterodimerization between ERBB receptors.
350. Derivative according to any of aspects 335 to 349, wherein said derivative inhibits and/or blocks ligand activation of an ERbB hetero-oligomer comprising HER2 and HER3, HER4 or EGFR.
351. Derivative according to any of aspects 335 to 350, wherein said derivative inhibits and/or blocks tumor vascularisation.
352. Derivative according to any of aspects 335 to 351, wherein said derivative recruits immune effector cells such as macrophages and monocytes to the tumor.
353. Derivative according to any of aspects 335 to 352, wherein said derivative inhibits and/or blocks TNF induced signalling and/or cell proliferation.
354. Derivative according to any of aspects 335 to 353, wherein said derivative down-regulates HER2 levels and/or downregulates HER2-mediated signalling pathways.
355. Derivative according to any of aspects 335 to 354, wherein said derivative inhibits and/or blocks metalloproteinase-mediated HER2 ectodomain shedding.
356. Derivative according to any of aspects 335 to 355, wherein said derivative inhibits, downregulates and/or blocks ligand-mediated ErbB signalling.

357. Derivative according to any of aspects 335 to 356, wherein said derivative inhibits and/or blocks HER2 ectodomain cleavage.
358. Derivative according to any of aspects 335 to 357, wherein said derivative inhibits and/or blocks Heregulin-mediated activation of MAPK/Erk1/2.
359. Derivative according to any of aspects 335 to 358, wherein said derivative inhibits and/or blocks PI3K/Akt
360. Derivative according to any of aspects 335 to 359, wherein said derivative modulates HER2 or HER2 mediated signalling via the same mechanism of action as Herceptin®.
361. Derivative according to any of aspects 335 to 360, wherein said derivative modulates HER2 or HER2 mediated signalling via the same mechanism of action as Omnitarg.
362. Derivative according to any of aspects 335 to 361, that can specifically bind to HER2 with a dissociation constant ($K_D$) of $10^{-5}$ to $10^{-12}$ moles/litre or less, and preferably $10^{-7}$ to $10^{-12}$ moles/litre or less and more preferably $10^{-8}$ to $10^{-12}$ moles/litre.
363. Derivative according to any of aspects 335 to 362, that can specifically bind to HER2 with a rate of association ($k_{on}$-rate) of between $10^2$ $M^{-1}$ $s^{-1}$ to about $10^7$ $M^{-1}$ $s^{-1}$, preferably between $10^3$ $M^{-1}$ $s^{-1}$ and $10^7$ $M^{-1}$ $s^{-1}$, more preferably between $10^4$ $M^{-1}$ $s^{-1}$ and $10^7$ $M^{-1}$ $s^{-1}$, such as between $10^5$ $M^{-1}$ $s^{-1}$ and $10^7$ $M^{-1}$ $s^{-1}$.
364. Derivative according to any of aspects 335 to 363, that can specifically bind to HER2 with a rate of dissociation ($k_{off}$-rate) between 1 $s^{-1}$ and $10^{-6}$ $s^{-1}$ preferably between $10^{-2}$ $s^{-1}$ and $10^{-6}$ $s^{-1}$, more preferably between $10^{-3}$ $s^{-1}$ and $10^{-6}$ such as between $10^{-4}$ $s^{-1}$ and $10^{-6}$ $s^{-1}$.
365. Derivative of a compound or construct according to any of aspects 151 to 234.
366. Derivative according to aspect 365, that can specifically bind to HER2.
367. Derivative according to aspect 366, wherein said derivative competes with Herceptin® for binding to HER2.
368. Derivative according to any of aspects 366 or 367, wherein said derivative inhibits and/or blocks binding of Herceptin® to HER2.
369. Derivative according to any of aspects 366 to 368, wherein said derivative is directed against the Herceptin® binding site on HER2.
370. Derivative according to any of aspects 366 to 369, wherein said derivative specifically binds to domain IV of HER2.
371. Derivative according to aspect 366, wherein said derivative competes with Omnitarg for binding to HER2.
372. Derivative according to any of aspects 366 or 371, wherein said derivative inhibits and/or blocks binding of Omnitarg to HER2.
373. Derivative according to any of aspects 371 or 372, wherein said derivative is directed against the Omnitarg binding site on HER2.
374. Derivative according to any of aspects 371 to 373, wherein said derivative specifically binds to domain II of HER2.
375. Derivative according to any of aspects 366 to 374, wherein said derivative competes with Herceptin® and Omnitarg for binding to HER2.
376. Derivative according to any of aspects 366 to 375, wherein said derivative inhibits and/or blocks binding of Herceptin® and Omnitarg to HER2.
377. Derivative according to any of aspects 366 to 376, wherein said derivative inhibits and/or blocks tumor cell proliferation.
378. Derivative according to any of aspects 366 to 377, wherein said derivative inhibits, downregulates and/or blocks cell signalling.
379. Derivative according to any of aspects 366 to 378, wherein said derivative induces apoptosis in tumor cells.
380. Derivative according to any of aspects 366 to 379, wherein said derivative inhibits and/or blocks heterodimerization between ERBB receptors.
381. Derivative according to any of aspects 366 to 380, wherein said derivative inhibits and/or blocks ligand activation of an ERbB hetero-oligomer comprising HER2 and HER3, HER4 or EGFR.
382. Derivative according to any of aspects 366 to 381, wherein said derivative inhibits and/or blocks tumor vascularisation.
383. Derivative according to any of aspects 366 to 382, wherein said derivative recruits immune effector cells such as macrophages and monocytes to the tumor.
384. Derivative according to any of aspects 366 to 383, wherein said derivative inhibits and/or blocks TNF induced signalling and/or cell proliferation.
385. Derivative according to any of aspects 366 to 384, wherein said derivative down-regulates HER2 levels and/or downregulates HER2-mediated signalling pathways.
386. Derivative according to any of aspects 366 to 385, wherein said derivative inhibits and/or blocks metalloproteinase-mediated HER2 ectodomain shedding.
387. Derivative according to any of aspects 366 to 386, wherein said derivative inhibits, downregulates and/or blocks ligand-mediated ErbB signalling.
388. Derivative according to any of aspects 366 to 387, wherein said derivative inhibits and/or blocks HER2 ectodomain cleavage.
389. Derivative according to any of aspects 366 to 388, wherein said derivative inhibits and/or blocks Heregulin-mediated activation of MAPK/Erk1/2.
390. Derivative according to any of aspects 366 to 389, wherein said derivative inhibits and/or blocks PI3K/Akt signalling.
391. Derivative according to any of aspects 366 to 390, wherein said derivative modulates HER2 or HER2 mediated signalling via the same mechanism of action as Herceptin®.
392. Derivative according to any of aspects 366 to 391, wherein said derivative modulates HER2 or HER2 mediated signalling via the same mechanism of action as Omnitarg.
393. Derivative according to any of aspects 366 to 392, that can specifically bind to HER2 with a dissociation constant ($K_D$) of $10^{-5}$ to $10^{-12}$ moles/liter or less, and preferably $10^{-7}$ to $10^{-12}$ moles/liter or less and more preferably $10^{-8}$ to $10^{-12}$ moles/liter.
394. Derivative according to any of aspects 366 to 393, that can specifically bind to HER2 with a rate of association ($k_{on}$-rate) of between $10^2$ $M^{-1}$ $s^{-1}$ to about $10^7$ $M^{-1}$ $s^{-1}$, preferably between $10^3$ $M^{-1}$ $s^{-1}$ and $10^7 M^{-1}$ $s^{-1}$, more preferably between $10^4$ $M^{-1}$ $s^{-1}$ and $10^7 M^{-1}$ $s^{-1}$, such as between $10^5$ $M^{-1}$ $s^{-1}$ and $10^7$ $M^{-1}$ $s^{-1}$.
395. Derivative according to any of aspects 366 to 394, that can specifically bind to HER2 with a rate of dissociation ($k_{off}$-rate) between 1 $s^{-1}$ and $10^{-6}$ $s^{-1}$ preferably between $10^{-2}$ $s^{-1}$ and $10^{-6}$ $s^{-1}$, more preferably between $10^{-3}$ $s^{-1}$ and $10^{-6}$ $s^{-1}$, such as between $10^{-4}$ $s^{-1}$ and $10^{-6}$ $s^{-1}$.
396. Derivative according to any of aspects 334 to 395, that has a serum half-life that is at least 1.5 times, preferably at least 2 times, such as at least 5 times, for example at least 10 times or more than 20 times, greater than the half-life of the corresponding amino acid sequence according to any of aspects 1 to 103 per se, Nanobody according to any of aspects 104 to 150 per se, or compound or construct according to any of aspects 151 to 234 per se.

397. Derivative according to any of aspects 334 to 396, that has a serum half-life that is increased with more than 1 hours, preferably more than 2 hours, more preferably more than 6 hours, such as more than 12 hours, or even more than 24, 48 or 72 hours, compared to the corresponding amino acid sequence according to any of aspects 1 to 103 per se or Nanobody according to any of aspects 104 to 150 per se, respectively.
398. Derivative according to any of aspects 334 to 397, that has a serum half-life in human of at least about 12 hours, preferably at least 24 hours, more preferably at least 48 hours, even more preferably at least 72 hours or more; for example, at least 5 days (such as about 5 to 10 days), preferably at least 9 days (such as about 9 to 14 days), more preferably at least about 10 days (such as about 10 to 15 days), or at least about 11 days (such as about 11 to 16 days), more preferably at least about 12 days (such as about 12 to 18 days or more), or more than 14 days (such as about 14 to 19 days).
399. Derivative according to any of aspects 334 to 398, that is a pegylated derivative.
400. Compound or construct, that comprises or essentially consists of one or more derivatives according to any of aspects 334 to 399, and optionally further comprises one or more other groups, residues, moieties or binding units, optionally linked via one or more linkers.
401. Compound or construct according to aspect 400, in which said one or more other groups, residues, moieties or binding units are amino acid sequences.
402. Compound or construct according to aspect 400, in which said one or more linkers, if present, are one or more amino acid sequences.
403. Nucleic acid encoding a compound or construct according to any of aspects 400 to 402 that is such that it can be obtained by expression of a nucleic acid or nucleotide sequence encoding the same.
404. Composition, comprising at least one derivative to any of aspects 334 to 399, compound or construct according to any of aspects 400 to 402, or nucleic acid or nucleotide sequence according to aspect 403.

FIGURE LEGENDS

FIG. 1: Anti-HER2 humoral immune response induced after immunisation of Llama glama with HER2-overexpressing SKBR3 cells. The reactivity of pre-immune (day 0) and immune sera (day 42 and day of PBL1 take) of animals 121 and 122 immunized with whole cells was determined by ELISA using rhErbB2-Fc as antigen (see Example 3.2). A: total IgG response; B: IgG1 isotype response; C: IgG2 isotype response; D: IgG3 isotype response.

Figure 2:
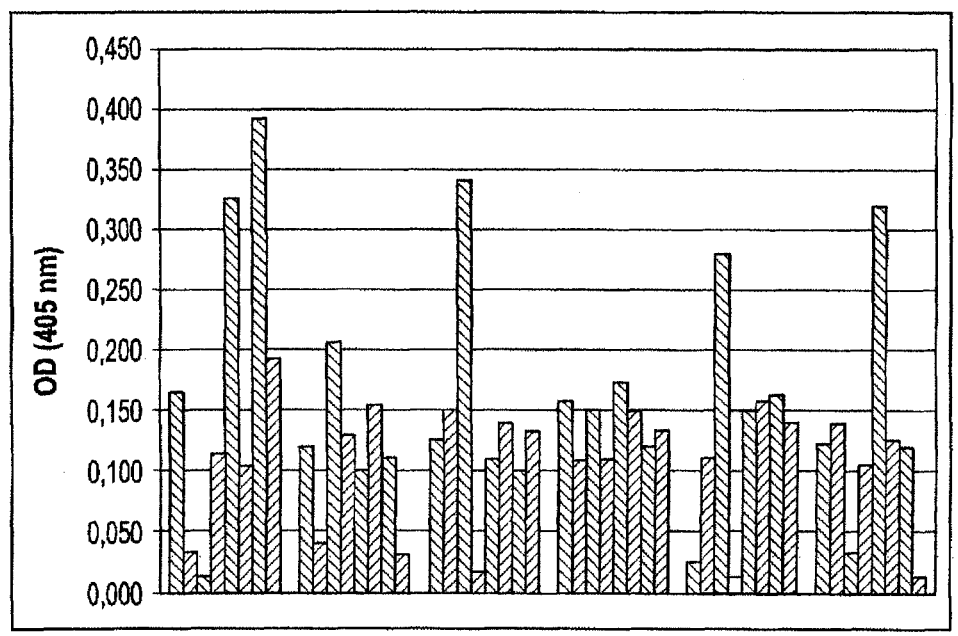

FIG. 2: HER2-specific ELISA analysis of periplasmic preparations containing myc-tagged Nanobody protein fragments from selected clones. Periplasmic preparations of soluble Nanobody protein fragments were added to wells of an ELISA plate, which had been coated with rhErbB2/Fc antigen and had been additionally blocked with PBS+1% casein. Detection was performed by a monoclonal anti-myc antibody followed by an alkaline phosphatase-conjugated polyclonal goat anti-mouse antibody. The ELISA was developed by a PNPP-substrate as described in Example 6. The OD-values (Y-axis) were measured at 405 nm by an ELISA-reader. Each bar represents an individual periplasmic extract.

Figure 3:
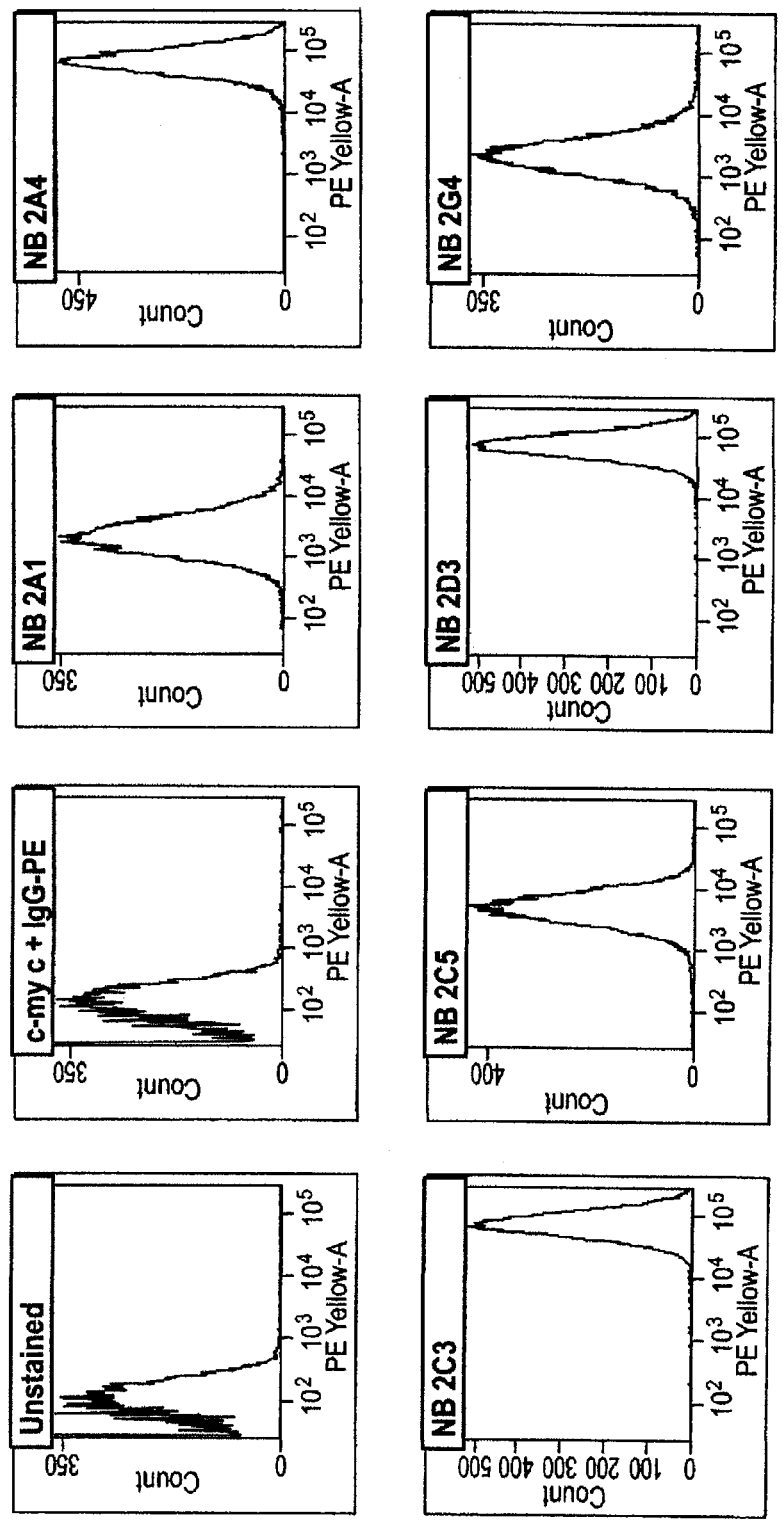

FIG. 3: Flow cytometric analysis of selected clones (2A1, 2A4, 2C3, 2C5, 2D3 and 2G4). Nanobody-containing periplasmic extracts were added to ErbB2 overexpressing SKBR3 cells. Detection was performed by a monoclonal anti-myc antibody followed by a PE-labeled polyclonal anti-mouse antibody. Nanobodies binding to cells was measured by an increase in fluorescence intensity as compared to cells that were incubated with FACS buffer (PBS+10% FBS) followed by monoclonal anti-myc antibody and PE-labeled polyclonal anti-mouse antibody. Fluorescence intensity is blotted on the X-axis, the number of events on the Y-axis.

Figure 4:
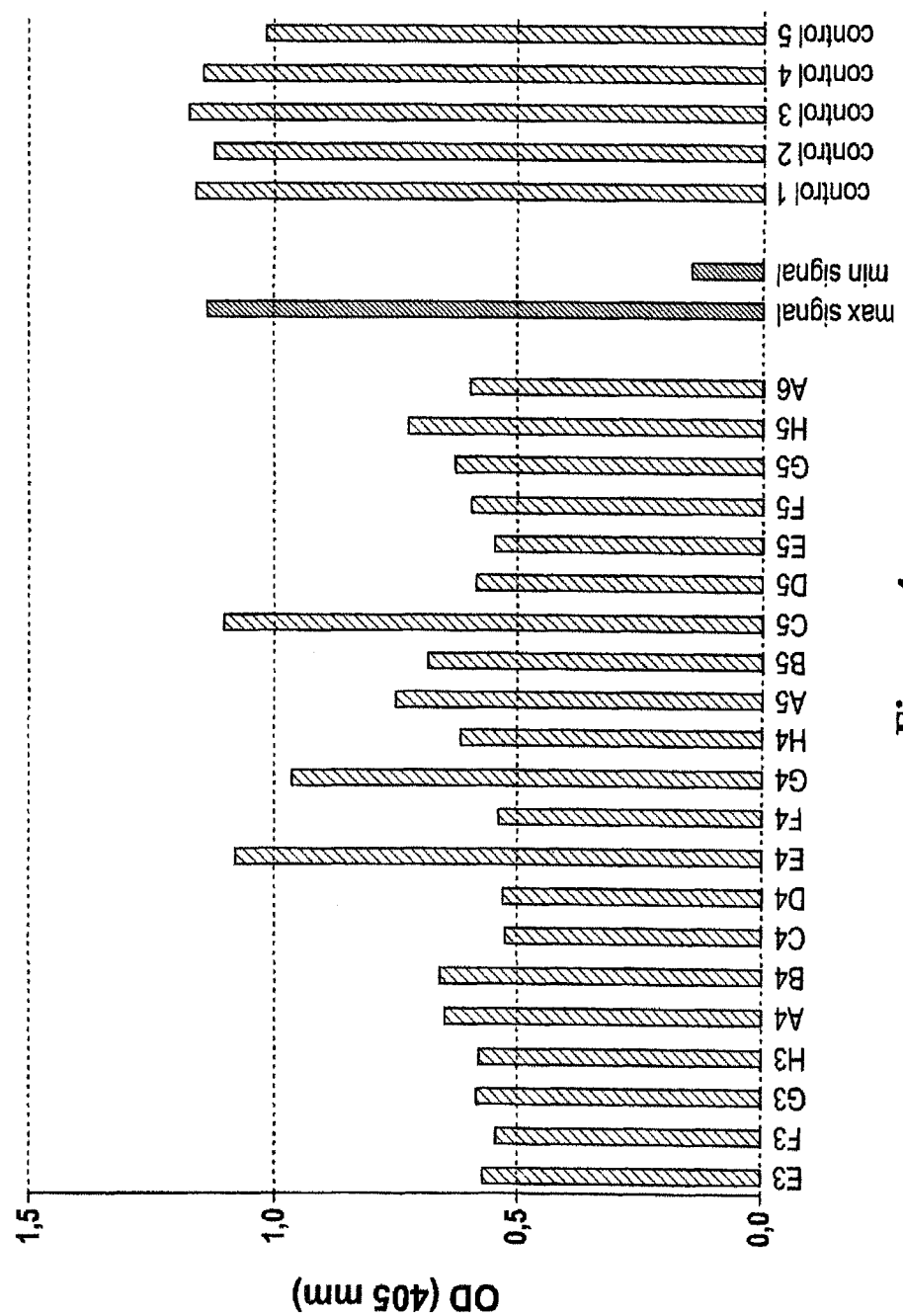

FIG. 4: Herceptin® competitive ELISA. An ELISA plate was coated with SKBR3 vesicles (5 µg/ml) and additionally blocked with PBS+1% casein. 2 nM Herceptin® was added to the wells, after which periplasmic preparations of soluble Nanobody protein fragments were added. Detection of Herceptin® binding to SKBR3 vesicles was performed by an alkaline phosphatase-conjugated AffiniPure Goat Anti-Human IgG, Fc Fragment Specific (Jackson ImmunoResearch Labs, Suffolk, UK). The ELISA was developed by a PNPP-substrate as described in Example 6. The OD-values (Y-axis) were measured at 405 nm by an ELISA-reader. Each bar represents an individual periplasmic extract. The OD value corresponding to the maximal signal represents the OD value measured for binding of Herceptin® without addition of periplasmic extract containing HER-binding Nanobody. The minimal signal represents the background staining of non-coated wells incubated only with alkaline phosphatase-conjugated AffiniPure Goat Anti-Human IgG, followed by detection using a PNPP-substrate. Controls 1-5 represent individual periplasmic extracts containing non-HER2 binding Nanobodies.

Figure 5:
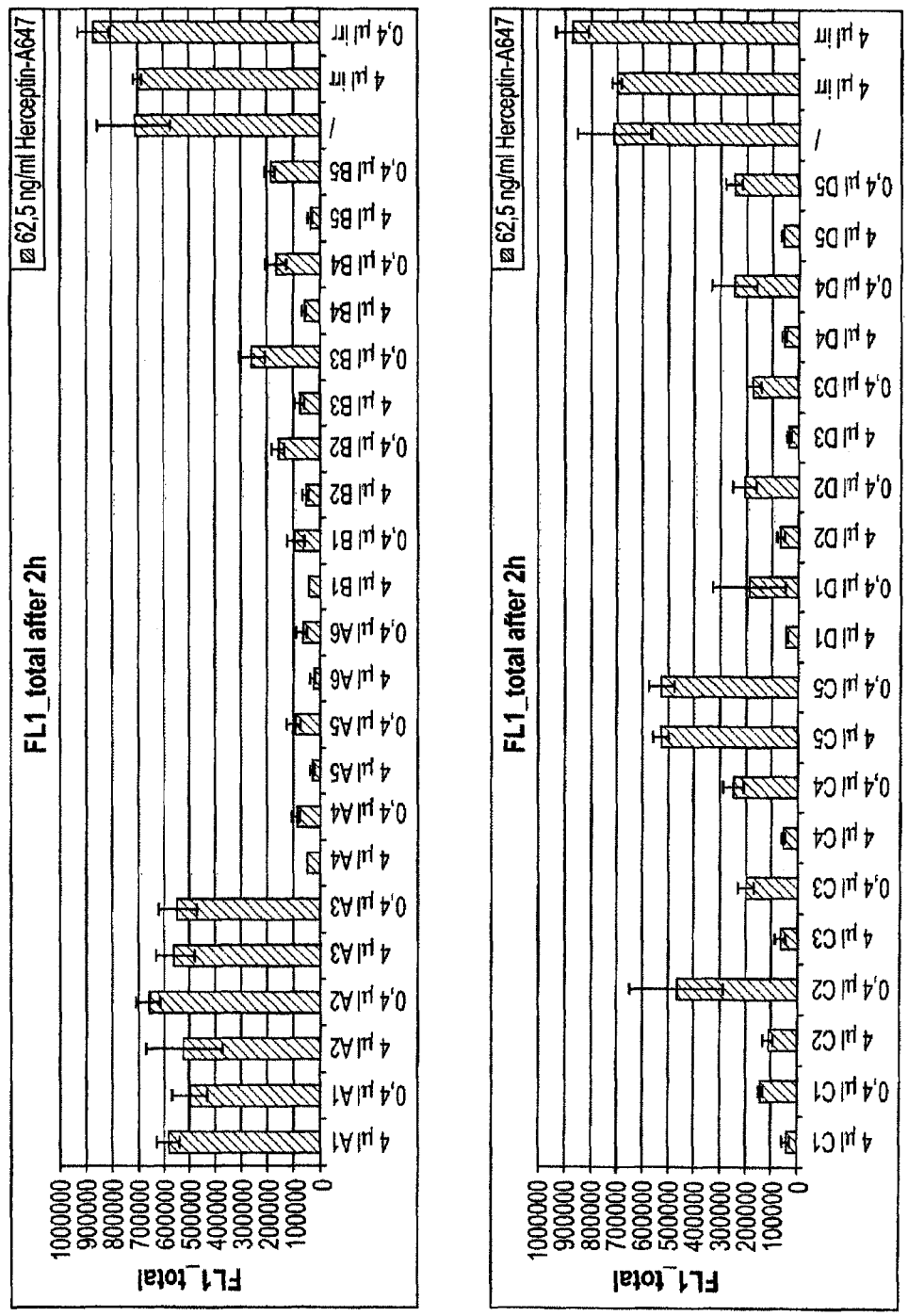

FIG. 5: Herceptin®-competitive FMAT. Dilutions of periplasmic extracts containing HER2 binding Nanobodies were tested for their ability to block the binding of Herceptin® to HER2-overexpressing SKBR3 cells as described in Example 8. (−) represents the signal obtained for binding of Alexa647-labeled Herceptin® without addition of periplasmic extract. Addition of periplasmic extract containing a non-HER2 binding Nanobody (irr) had no influence on the binding of Herceptin® to SKBR3 cells. Periplasmic extracts 2A4, 2A5, 2A6, 2B1, 2B2, 2B4, 2B5, 2C1, 2C3, 2D2 and 2D3 blocked binding of Herceptin® to HER2 with more than 80%.

Figure 6:
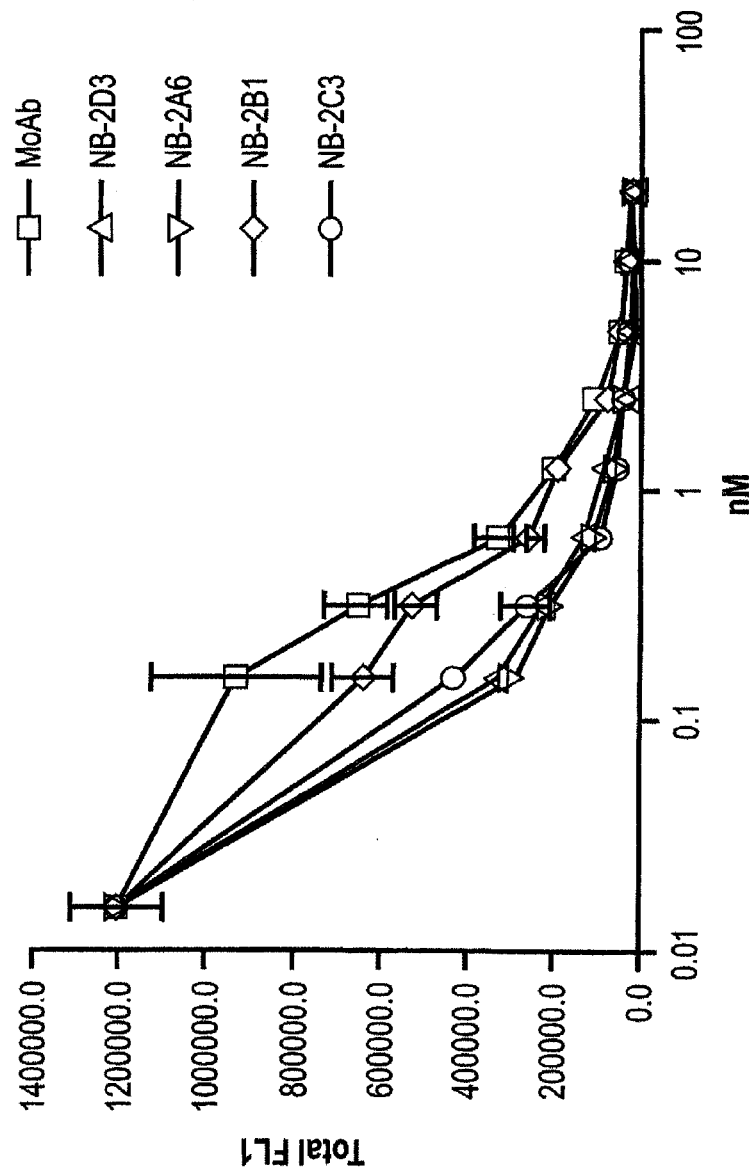

FIG. 6: Herceptin®-competitive FMAT analysis. Nanobodies compete with binding of Herceptin® to SKBR3 cells in a dose-dependent manner as described in Example 8.

Figure 7:
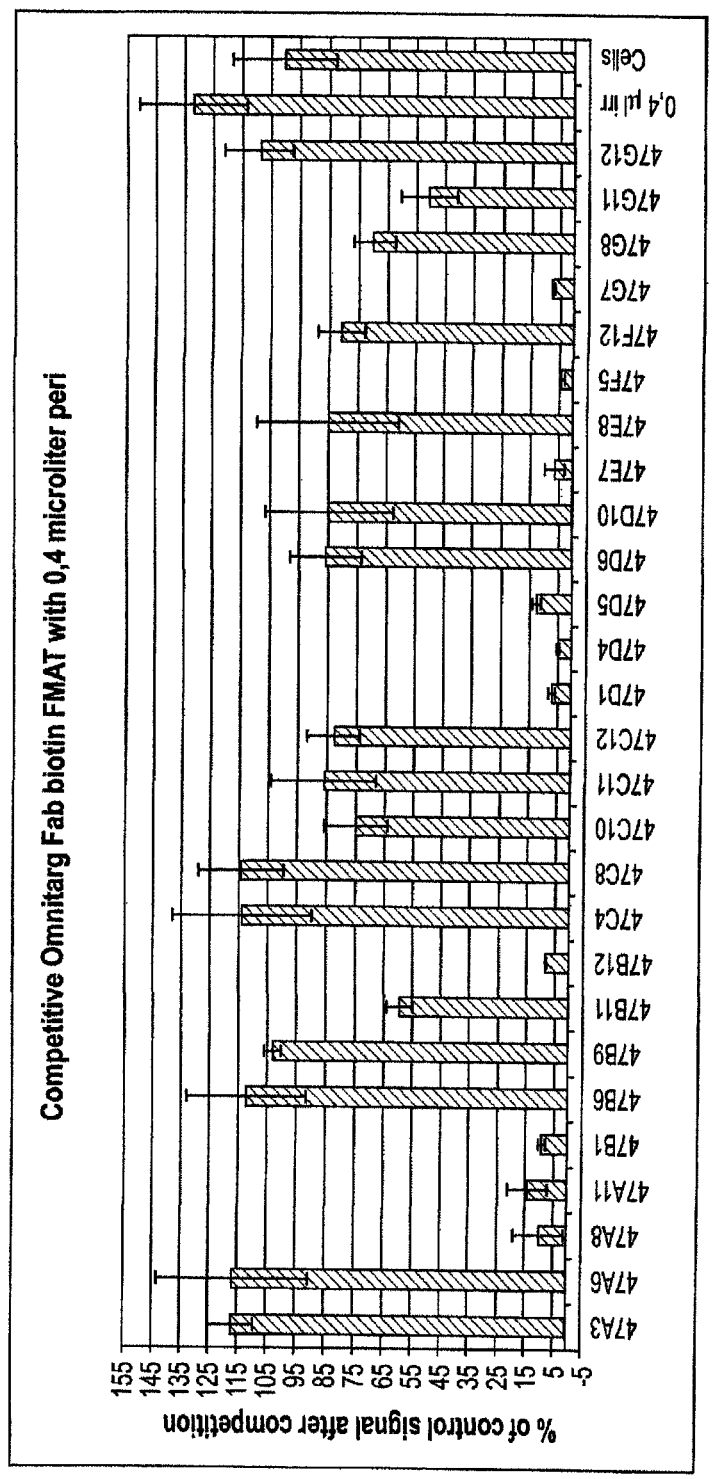

FIG. 7: Omnitarg-Fab competitive FMAT. Dilutions of periplasmic extracts containing HER2 binding Nanobodies were tested for their ability to block the binding of Omnitarg-Fab (OT-Fab) to HER2-overexpressing SKBR3 cells as described in Example 9. (cells) represents the signal obtained for binding of biotinylated OT-Fab without addition of periplasmic extract. Addition of periplasmic extract containing a non-HER2 binding Nanobody (irr) had no influence on the binding of OT-Fab to SKBR3 cells. Periplasmic extracts 47A8, 47A11, 47B1, 47B12, 47D1, 47D4, 47D5, 47E7, 47F5 and 47G7 blocked binding of OT-Fab to HER2 with more than 85%.

Figure 8:
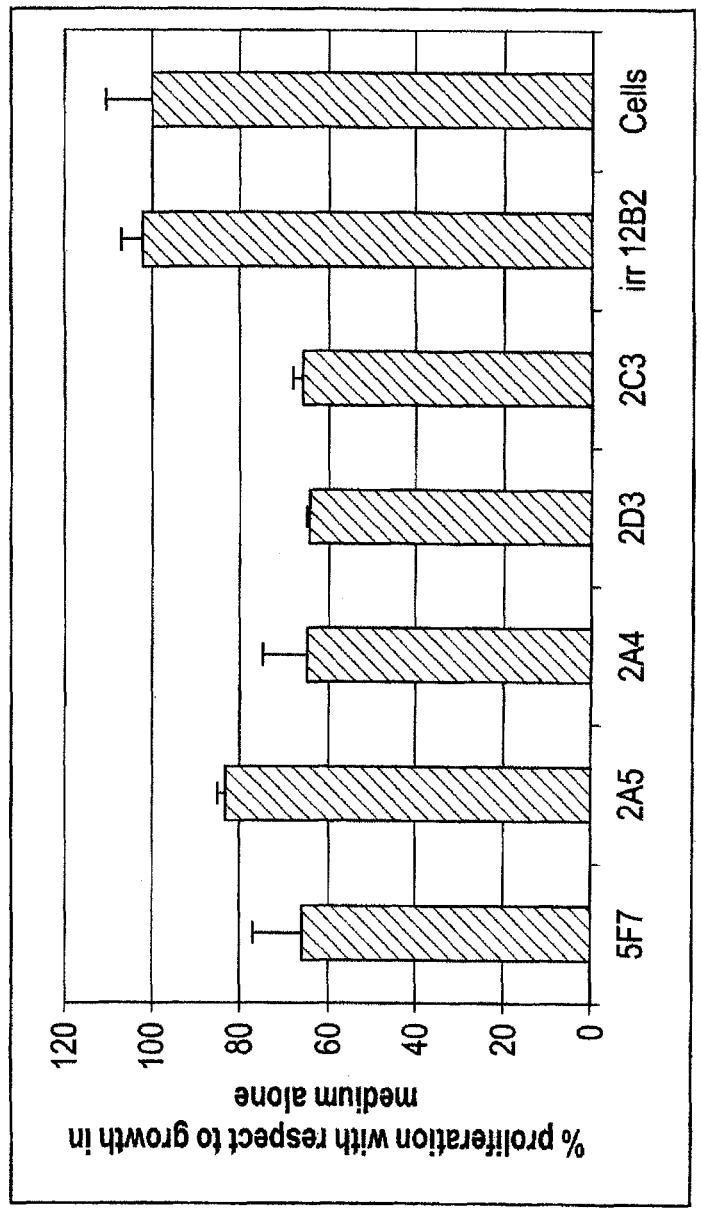

FIG. 8: Growth inhibitory effect of monovalent HER2 binding Nanobodies on ErbB2-overexpressing SKBR3 cells. SKBR3 cells were seeded in 96 well plates and allowed to adhere as explained in Example 11. HER2-binding Nanobodies 5F7, 2A5, 2A4, 2D3 and 2C3, non-HER2 binding irrelevant Nanobody 12B2 or medium alone were added and the cells were incubated for 3 days. During the last 24 h, cells were pulsed with 1 µCi [$^3$H]-thymidine. Incorporation of [$^3$H]-thymidine was measured as described in Example 11.

Figure 9A:
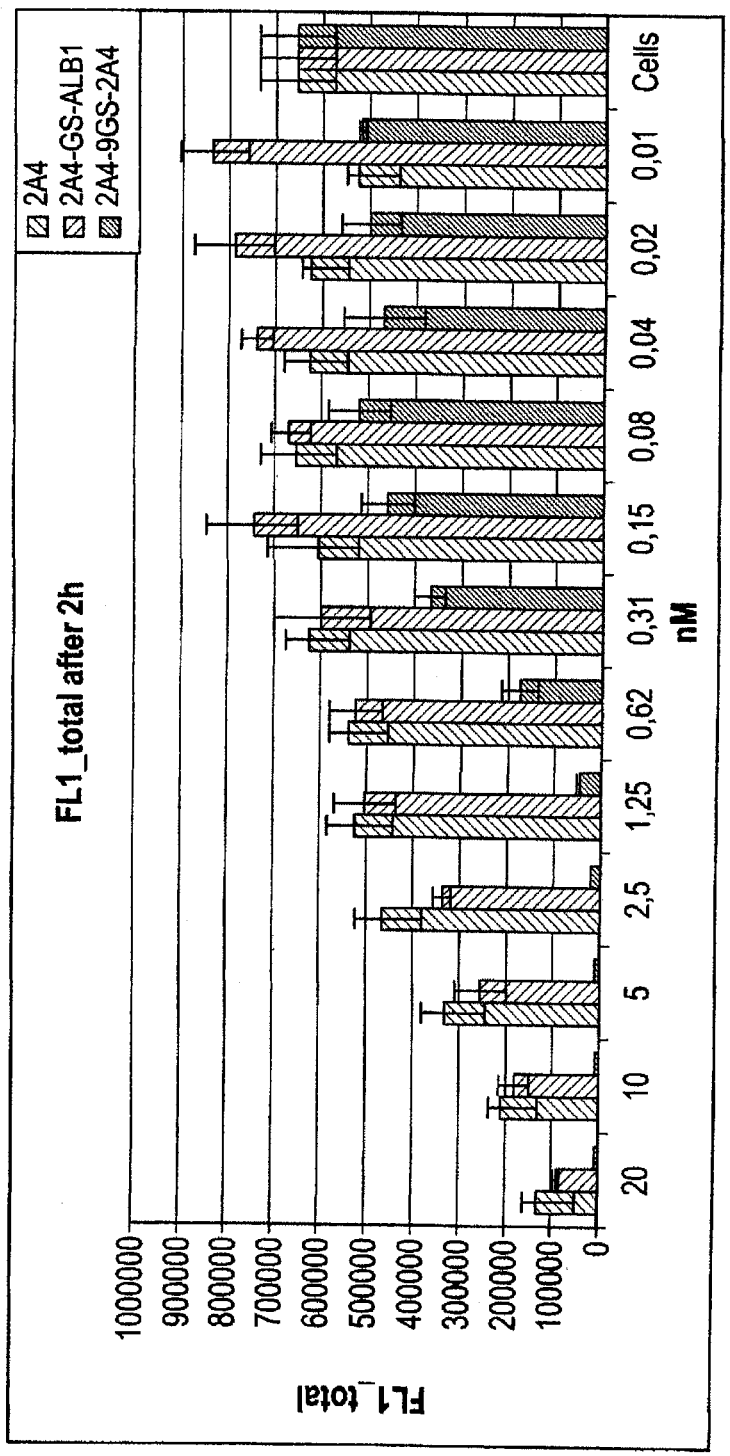
Figure 9B:
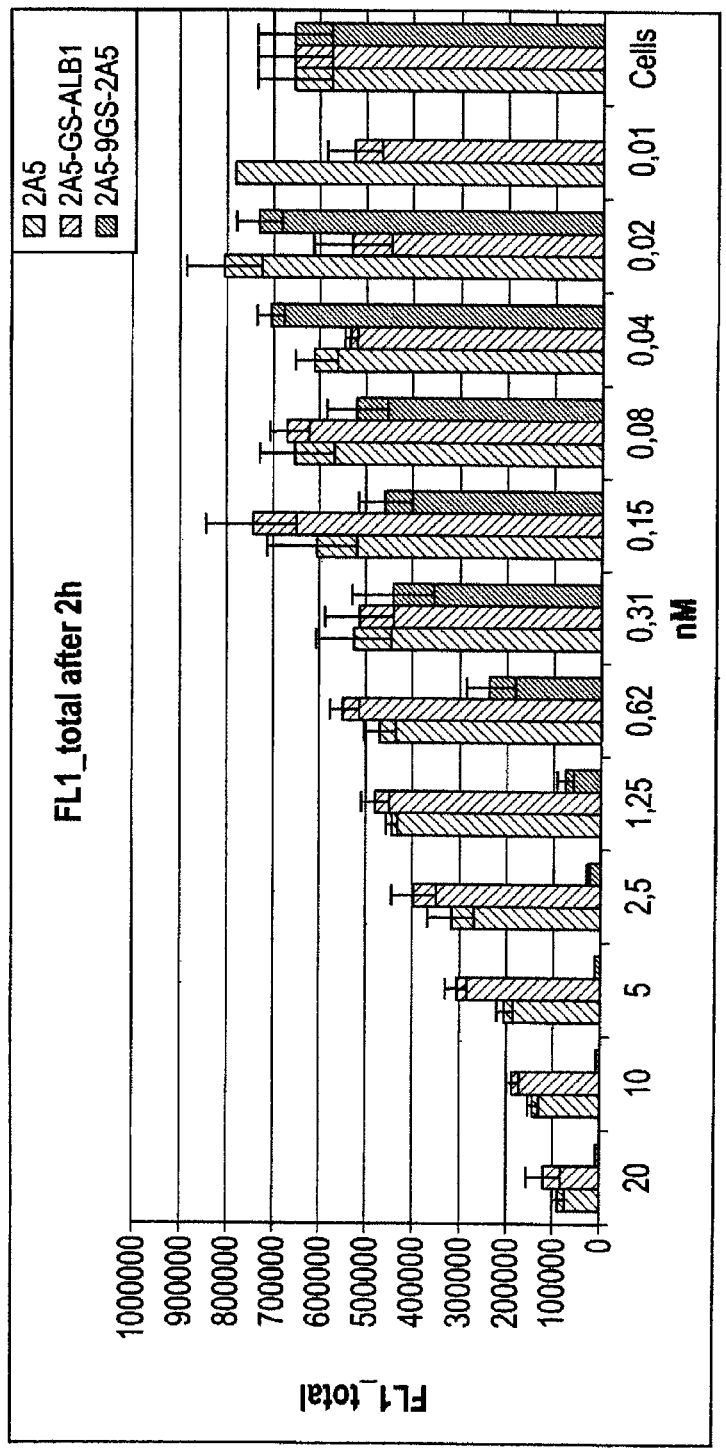

FIG. 9: Herceptin®-competitive FMAT. Dilutions of monovalent, bivalent and bispecific Nanobodies were tested for their ability to block the binding of Herceptin® to HER2-overexpressing SKBR3 cells as described in Example 12. Bispecific Nanobodies 2A4-9GS-ALB1 and 2A5-9GS-ALB1 blocked the binding of Herceptin® to HER2-expressing SKBR3 cells to the same extent as the monovalent 2A4 and 2A5 Nanobodies respectively. Bivalent 2A4-9GS-2A4 and 2A5-9GS-2A5 Nanobodies blocked the binding of Herceptin® to HER2-expressing SKBR3 cells to a greater extent than their monovalent format. A: 2A4 derivatives; B: 2A5 derivatives.

Figure 10:
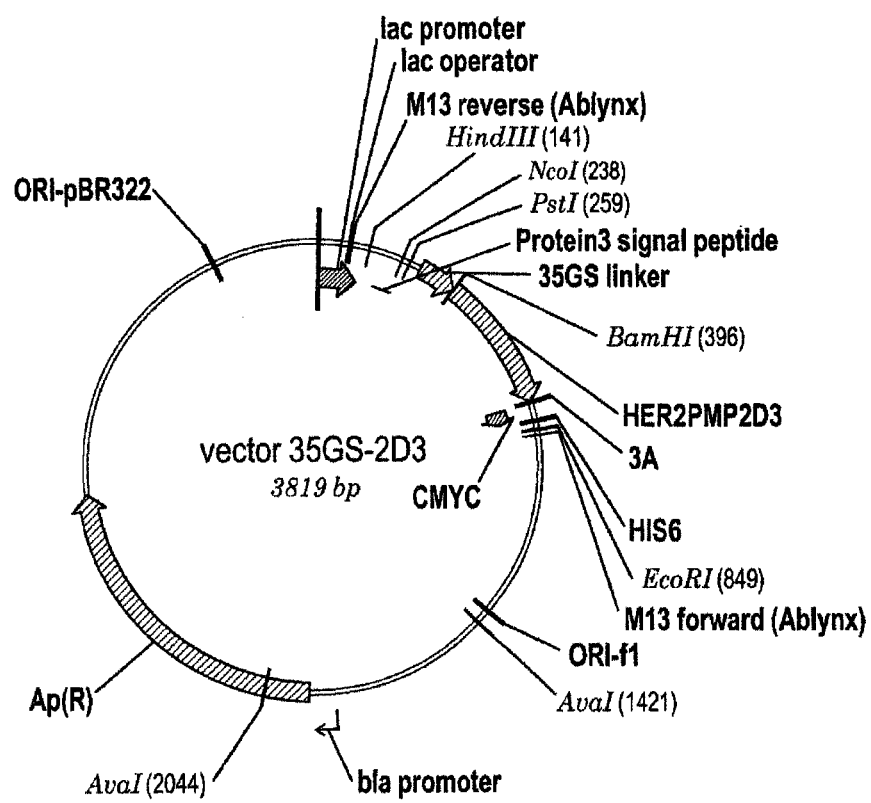

FIG. 10: Design of biparatopic Nanobody expression vector as described in Example 13.1.

Figure 11:
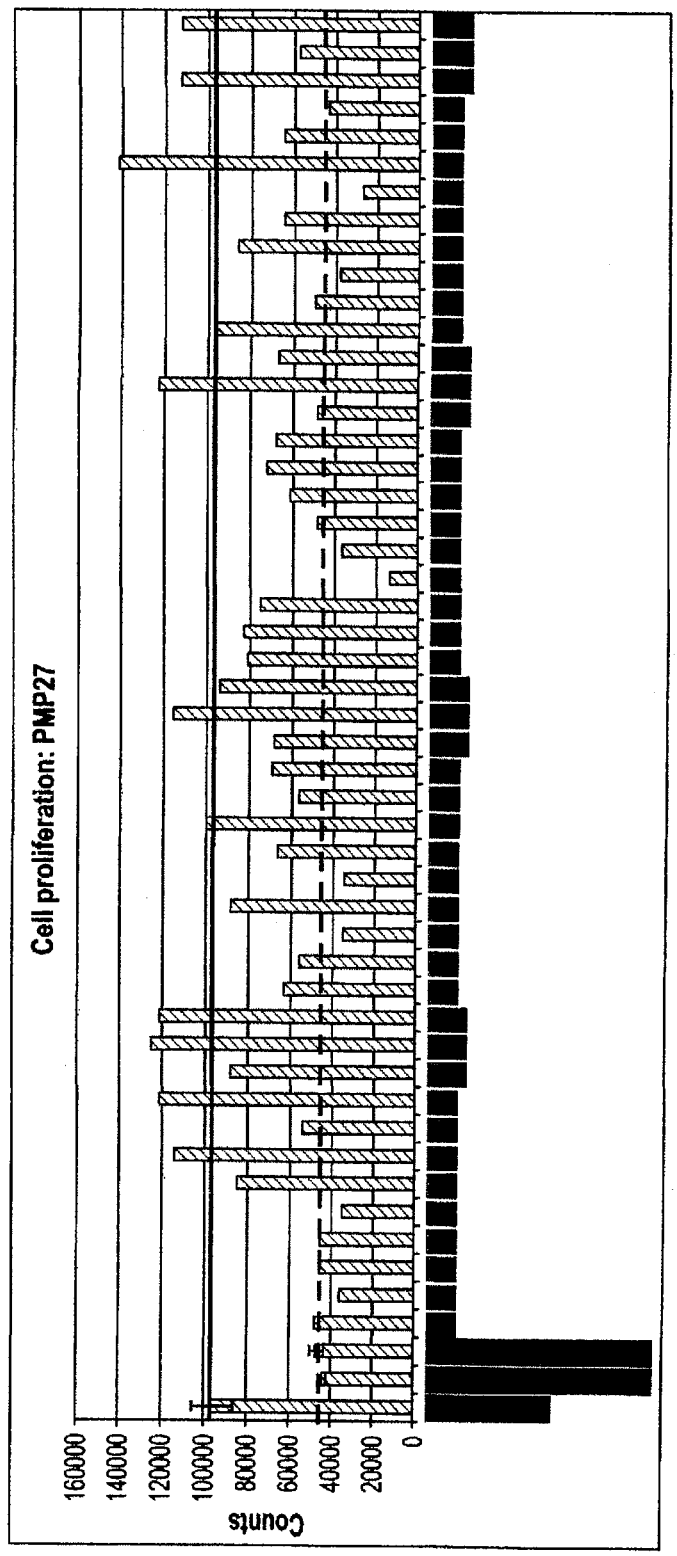

FIG. 11: SKBR3 cell proliferation assay with biparatopic Nanobodies purified from periplasmic extracts derived from plate 27 by PhyTip200+. Biparatopic Nanobodies 27A2-35GS-2D3, 27A5-35GS-2D3, 27B3-35GS-2D3, 27B5-35GS-2D3, 27C4-35GS-2D3, 27D3-35GS-2D3 and 27D6-35GS-2D3 block SKBR3 cell proliferation to a greater extent than 50 nM Herceptin®. Biparatopic Nanobodies 27A7-35GS-2D3, 27A9-35GS-2D3, 27A11-35GS-2D3, 27A12-35GS-2D3, 27B11-35GS-2D3, 27C11-35GS-2D3 and 27D7-35GS-2D3 display an agonistic effect.

Figure 12:
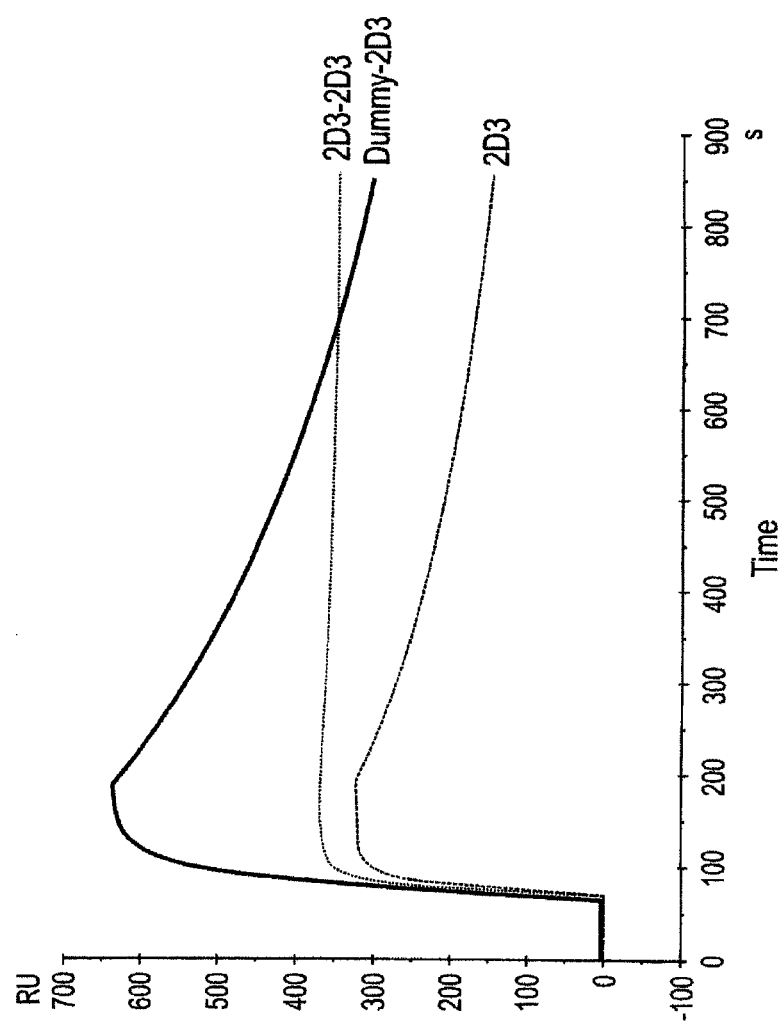

FIG. 12: Sensorgram of monovalent 2D3, bivalent 2D3-35GS-2D3 and dummy-2D3 biparatopic Nanobodies.

Figure 13:
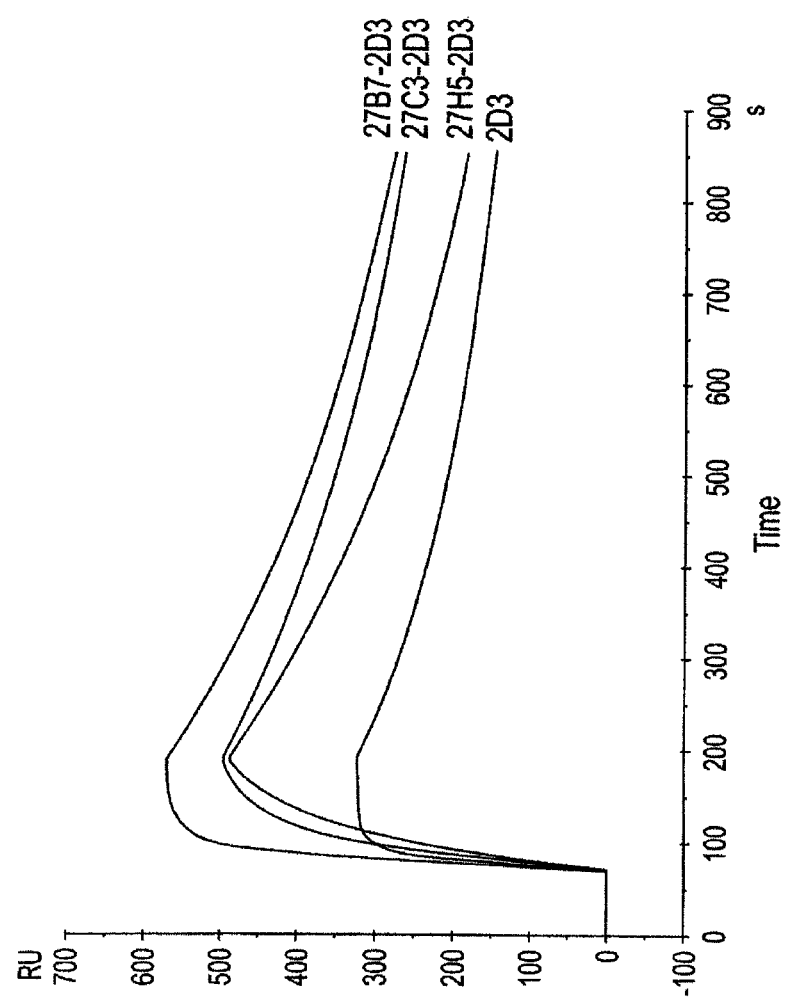

FIG. 13: Sensorgram of monovalent 2D3 and biparatopic Nanobodies 27B7-35GS-2D3, 27C3-35GS-2D3 and 27H5-350S-2D3.

Figure 14:
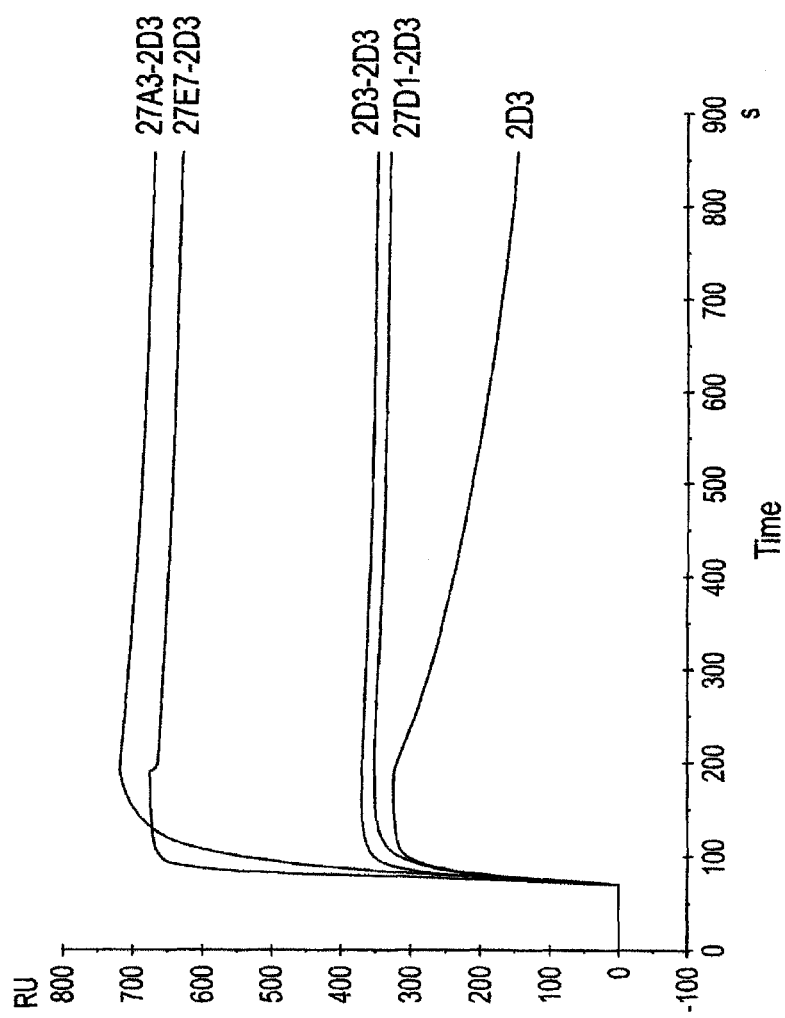

FIG. 14: Sensorgram of monovalent 2D3, bivalent 2D3-35GS-2D3 and biparatopic Nanobodies 27A3-35GS-2D3, 27E7-35GS-2D3 and 27D1-35GS-2D3.

FIG. 15: Herceptin®-competitive FMAT. Dilutions of monovalent 2D3, bivalent 2D3-35GS-2D3 and biparatopic Nanobodies combining the Herceptin®-competitive 2D3 and a HER2-binding or dummy Nanobody were tested for their ability to block the binding of Herceptin® to HER2-overexpressing SKBR3 cells as described in Example 14.2. A: Bivalent 2D3-35GS-2D3 and biparatopic Nanobodies 27H3-35GS-2D3 and 27D1-35GS-2D3 block binding of Herceptin® to HER2 expressed on SKBR3 cells more efficiently than monovalent 2D3 Nanobody. B: Nanobodies 27A3, 27A5 and 30D10 have no influence on the Herceptin®-competitive behavior of Nanobody 2D3 when fused to its N-terminal end, spaced by a 35GS linker. C: Nanobodies 27B7, 27C3, 27H5 and the dummy Nanobody have an inhibitory effect on the Herceptin®-competitive potential of 2D3 when fused to its N-terminal end, spaced by a 35GS linker.

Figure 16:
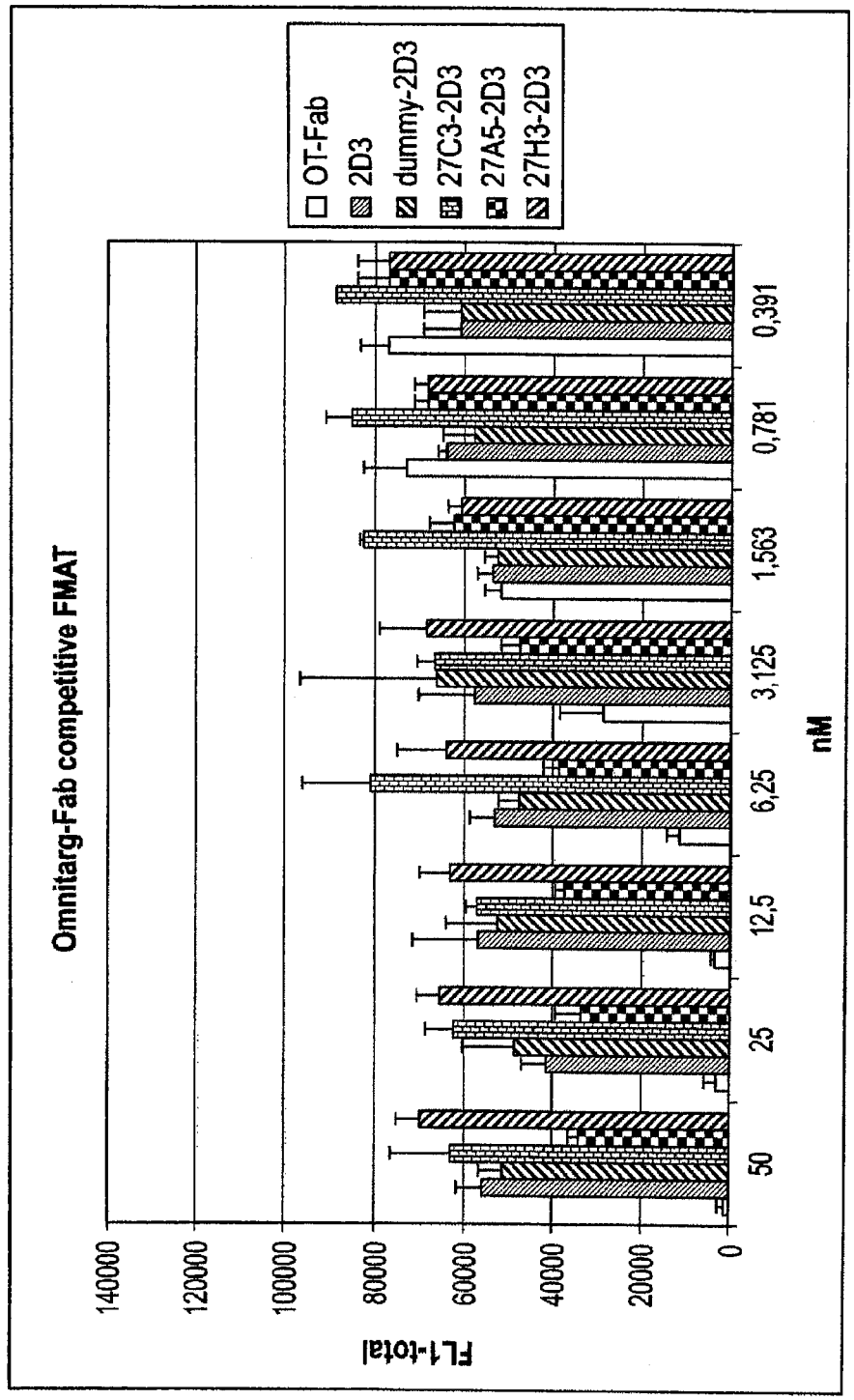

FIG. 16: Omnitarg-Fab competitive FMAT. Dilutions of OT-Fab, monovalent 2D3 and biparatopic Nanobodies 27C3-35GS-2D3, 27A5-35GS-2D3, 27H3-35GS-2D3 and dummy-35GS-2D3 were tested for their ability to block the binding of OT-Fab to HER2-overexpressing SKBR3 cells as described in Example 14.3. None of the bipartope Nanobodies, nor monovalent 2D3 blocked the binding of OT-Fab to HER2 expressed on SKBR3 cells. OT-Fab blocked binding of biotinylated OT-Fab in a dose-dependent manner.

Figure 17:
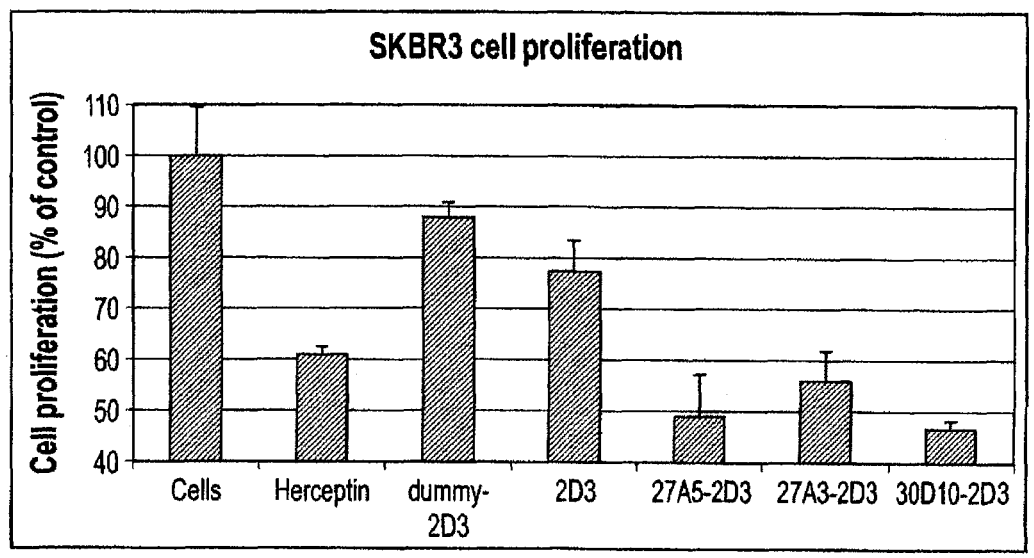

FIG. 17: Effect of biparatopic Nanobodies on SKBR3 tumor cell proliferation. Biparatopic Nanobodies 27A5-35GS-2D3, 27A3-35GS-2D3 and 30D10-35GS-2D3 significantly block proliferation of SKBR3 tumor cells and to a greater extent than the monovalent 2D3 and dummy-2D3 biparatopic Nanobody.

Figure 18:
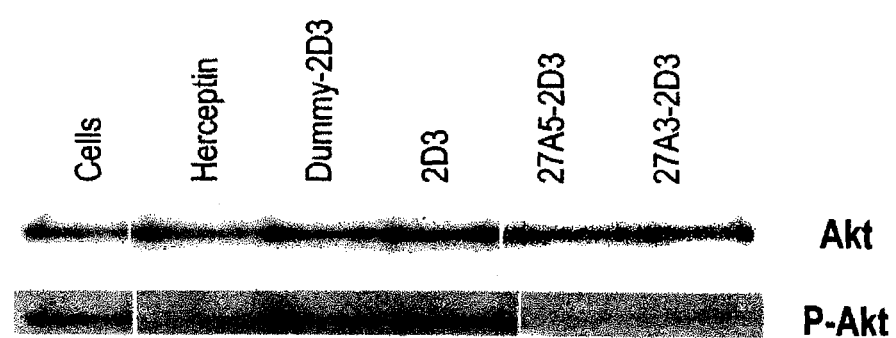

FIG. 18: Effect of biparatopic Nanobodies on AKT signaling in SKBR3 cells (see Example 16). Biparatopic 27A3-35GS-2D3 and 27A5-35GS-2D3, Herceptin®, but not dummy-2D3 biparatopic or monovalent 2D3 Nanobody inhibits AKT phosphorylation in whole SKBR3 cell lysates.

Figure 19:
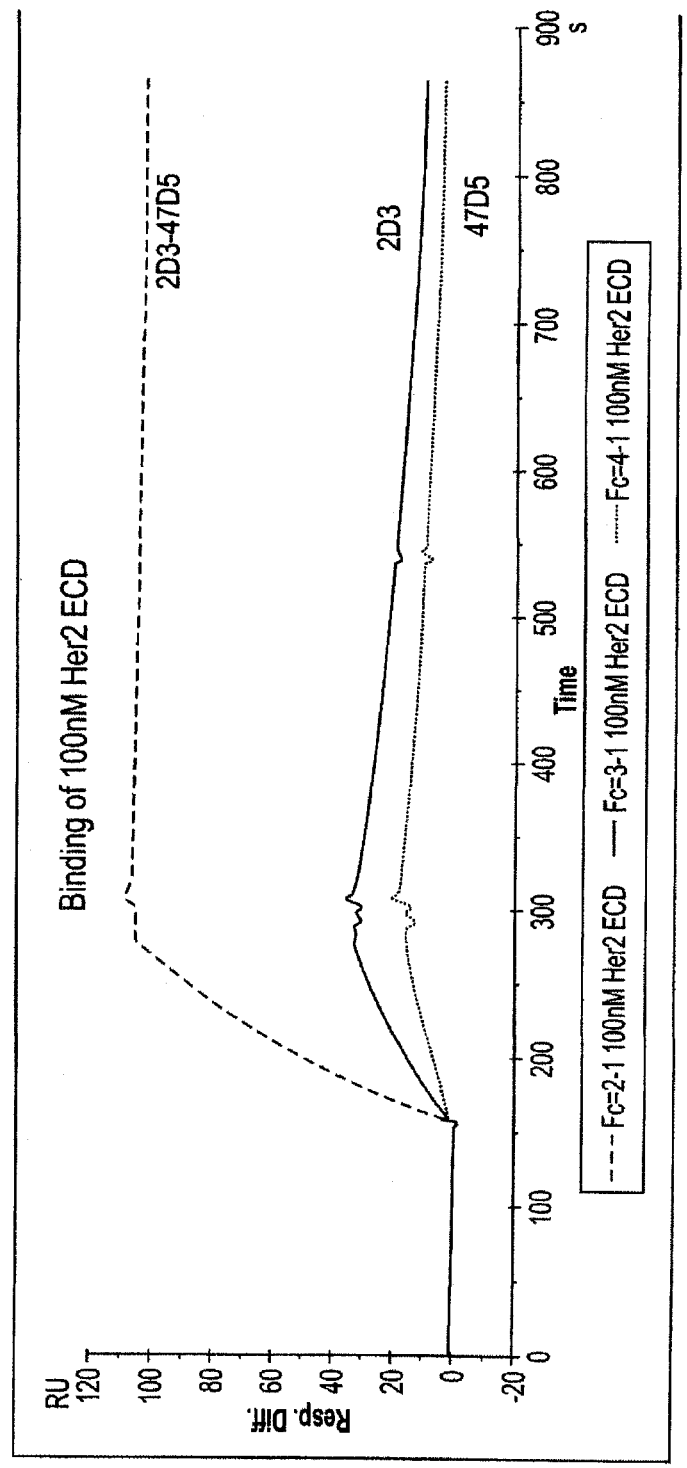

FIG. 19: Sensorgram of HER2-ECD binding to 2D3, 47D5 or the biparatopic Nanobody 2D3-35GS-47D5.

Figure 20:
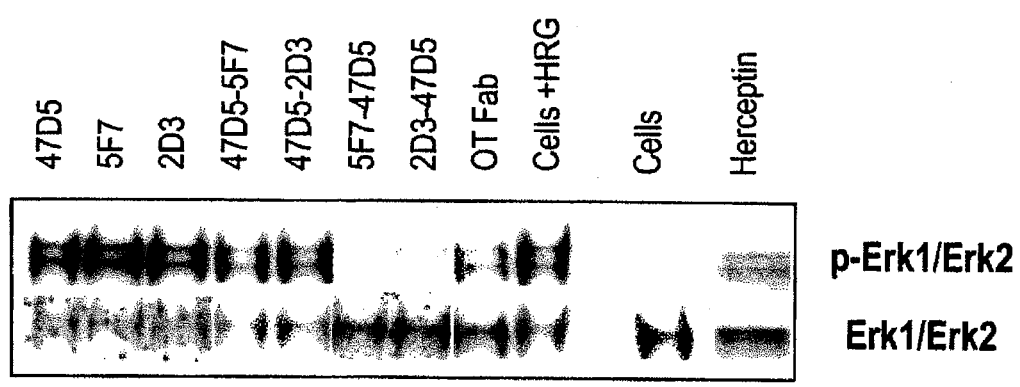

FIG. 20: Effect of biparatopic Nanobodies combining Herceptin®-competitive and Omnitarg competitive Nanobodies, monovalent Nanobodies 2D3, 5F7 and 47D5, Omnitarg-Fab and Herceptin® on HRG-mediated activation of mitogen-activated protein kinase (MAPK).

Figure 21:
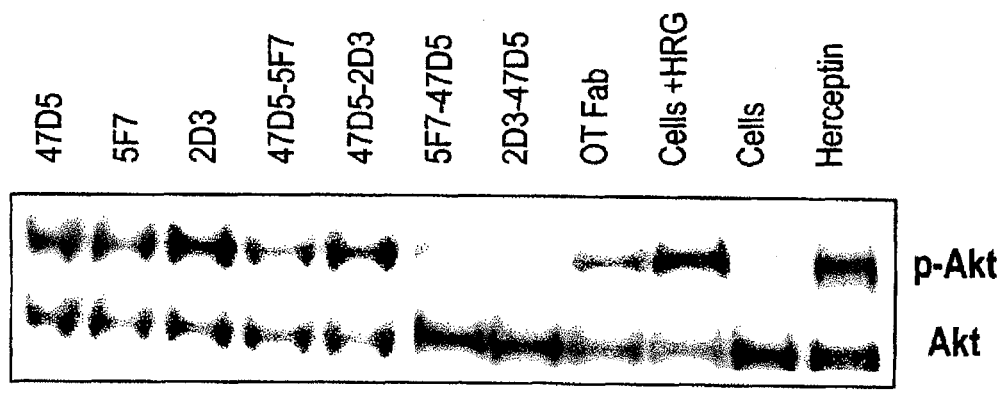

FIG. 21: Effect of biparatopic Nanobodies combining Herceptin®-competitive and Omnitarg competitive Nanobodies, monovalent Nanobodies 2D3, 5F7 and 47D5, Omnitarg-Fab and Herceptin® on HRG-mediated activation of Akt signaling.

Figure 22A:
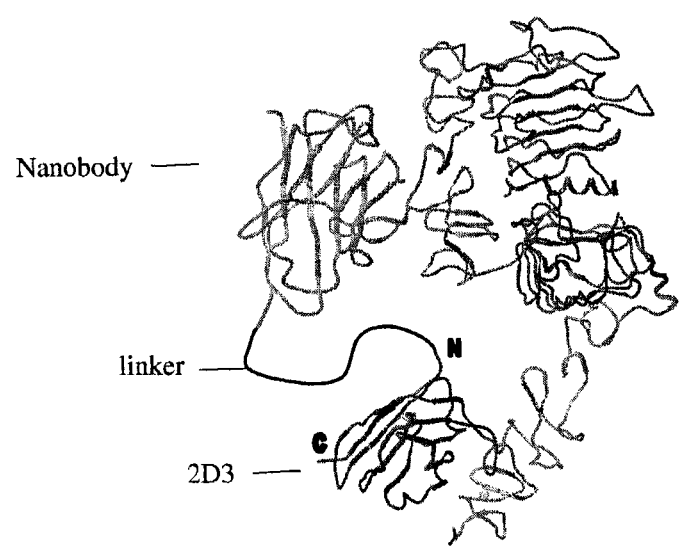
Figure 22B:
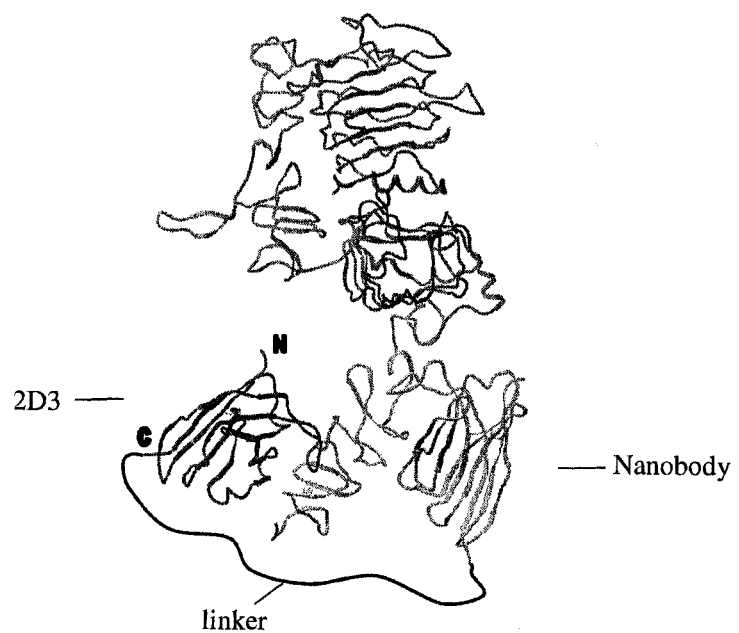

FIGS. 22A and 22B: Model of NB-2D3 (indicated) linked to another Nanobody (indicated) docked on HER-2. The linker is indicated as well. N denotes the N-terminus of NB-2D3; C is the C-terminus of Nb-2D3.

Figure 23:
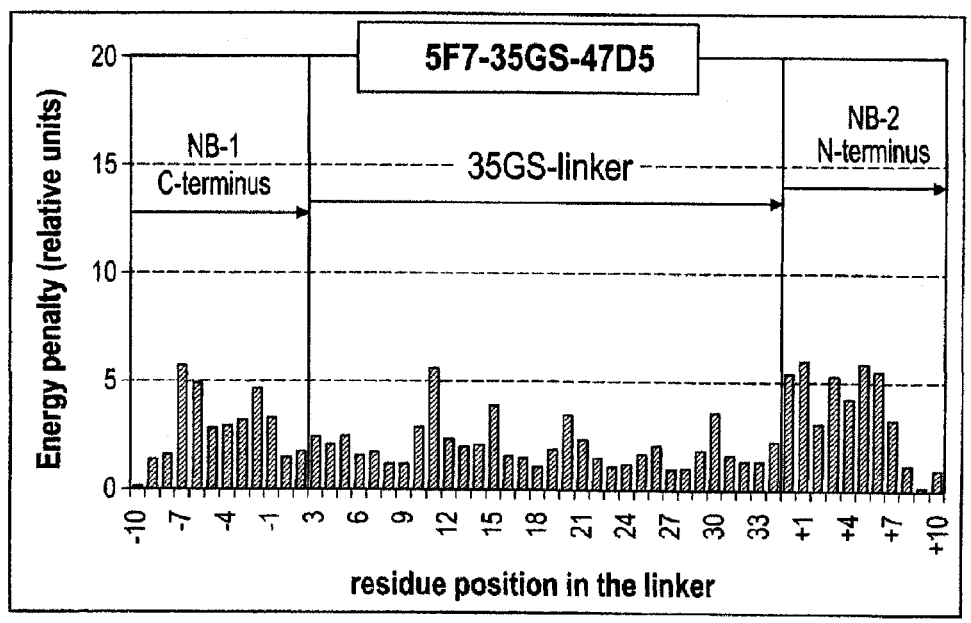

FIG. 23: Energy penalty values for each residue in the linker +/−10 residues of each Nanobody connected to the linker in the biparatopic construct 5F7-35GS-47D5 with appropriate linker length. None of the residues of the linker or at the connection points of the linker with the Nanobodies (NB-1 and NB-2) have a high energy penalty value.

Figure 24:
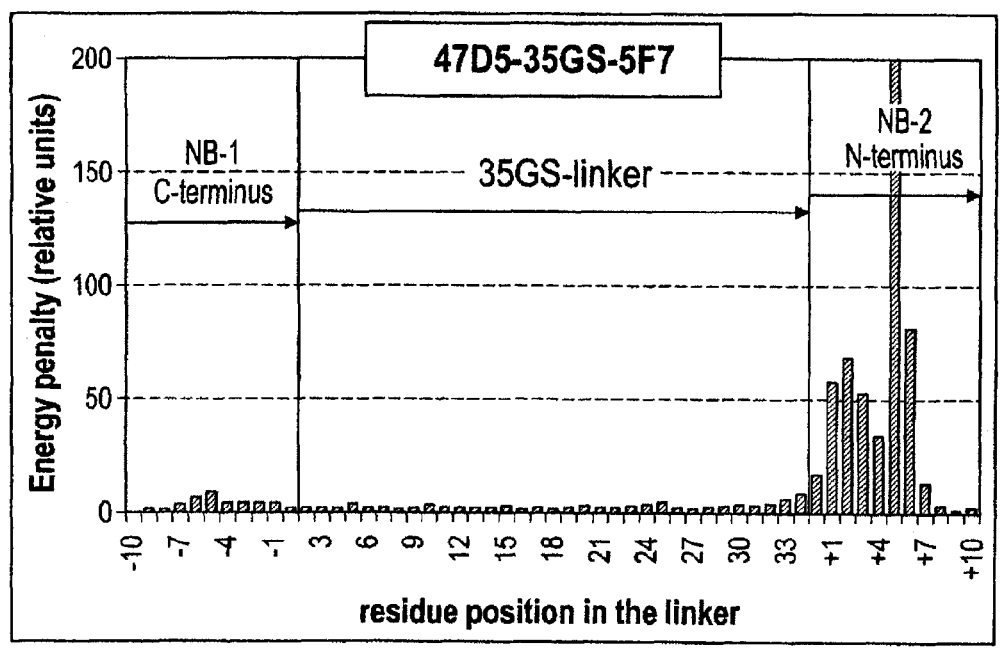

FIG. 24: Energy penalty values for each residue in the linker +/−10 residues of each Nanobody connected to the linker in the biparatopic construct 47D5-35GS-5F7 with unappropriate linker length. High energy penalty values are observed at the C-terminal connection of the linker with the N-terminal end of the second Nanobody (NB-2).

Figure 25:
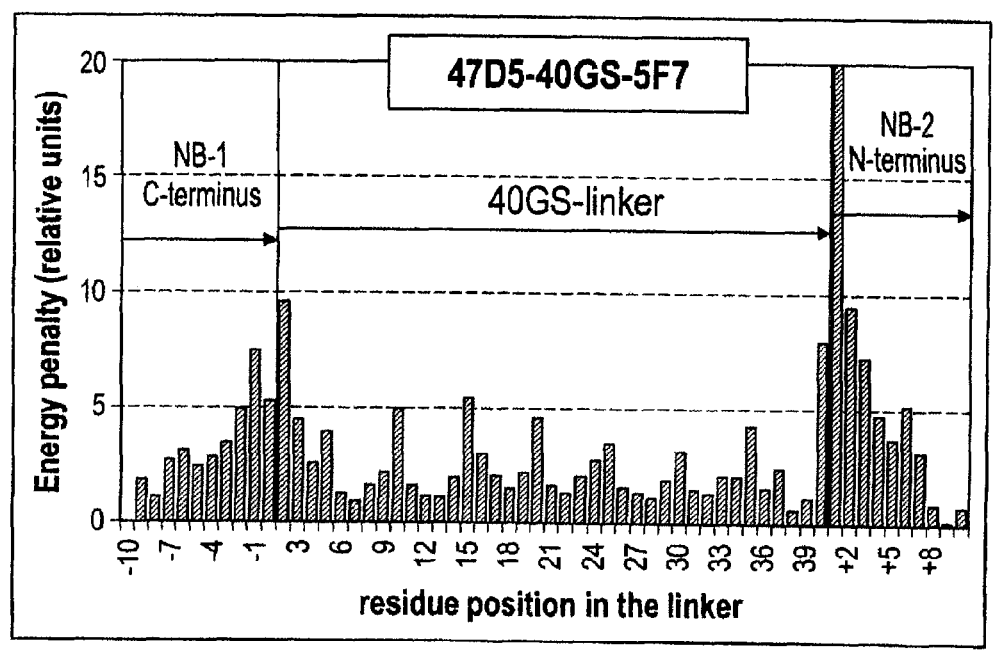

FIG. 25: Energy penalty values for each residue in the linker +/−10 residues of each Nanobody connected to the linker in a biparatopic construct with the same Nanobodies as in FIG. 23 but with a longer linker length (47D5-40GS-5F7). We see that the high energy penalty values at the connection of the C-terminal end of the linker with the N-terminal end of NB-2 are reduced suggesting a more appropriate linker length. The energy penalty values at both ends of the linker are still higher than those observed in FIG. 22, indicating a still not optimal linker.

Figure 26A:
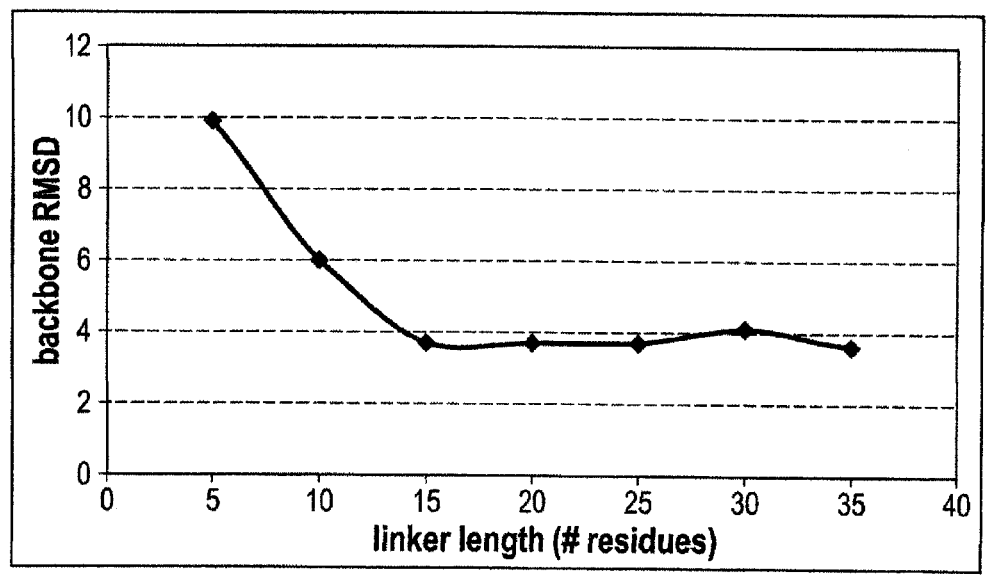

FIG. 26A: Backbone RMSD (Å$^2$) between the 5F7-linker-47D5 constructs (built by homology modelling) with the individual Nanobodies 5F7 and 47D5 in their unlinked binding mode. The linker length varies from 5 to 35.

Figure 26B:
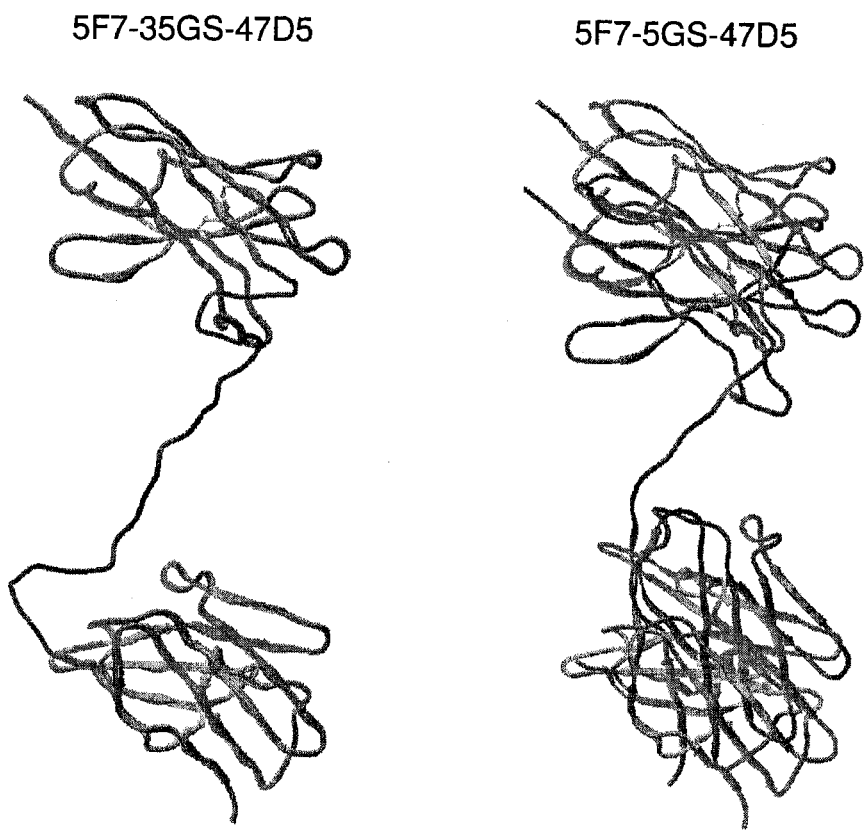
Figure 27A:
Figure 27A:
Figure 27B:
Figure 27B:
Figure 27C:
Figure 27C:
Figure 27E:
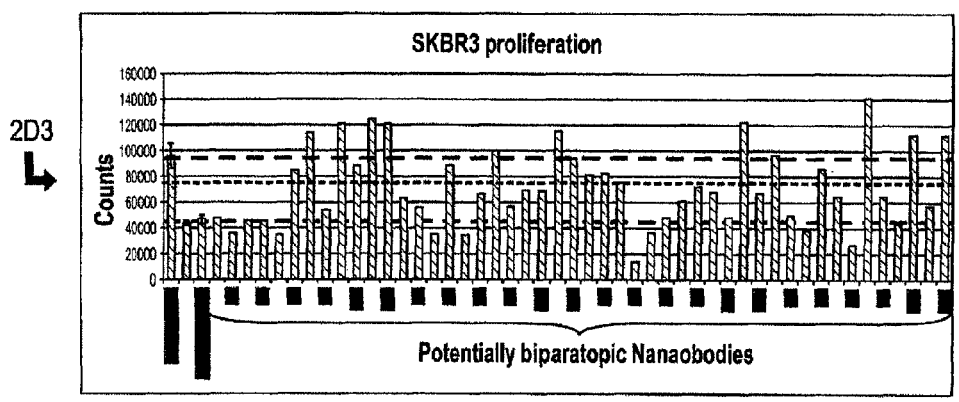
Figure 27F:
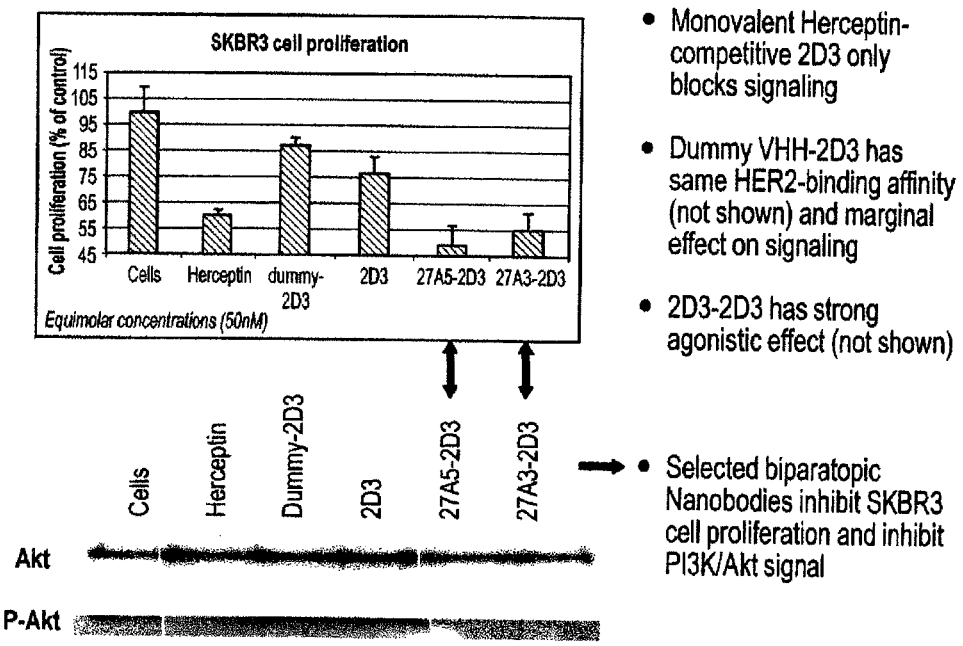
Figure 27G:
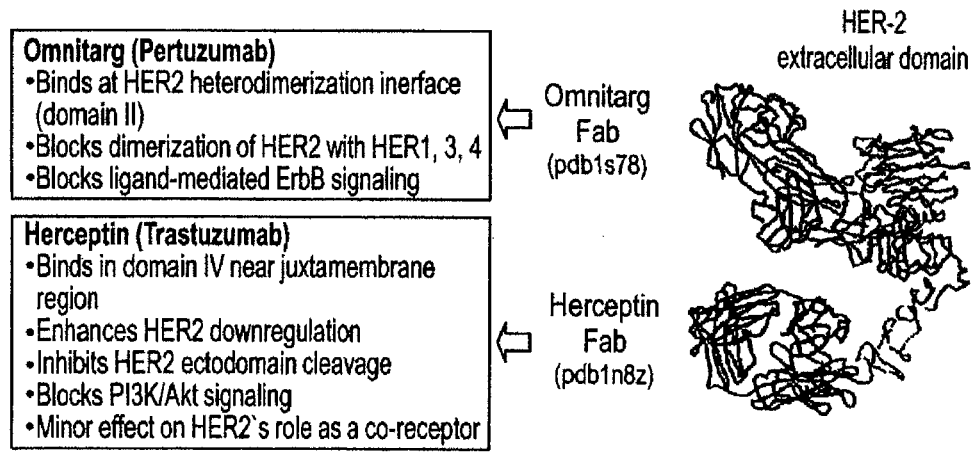
Figure 27I:
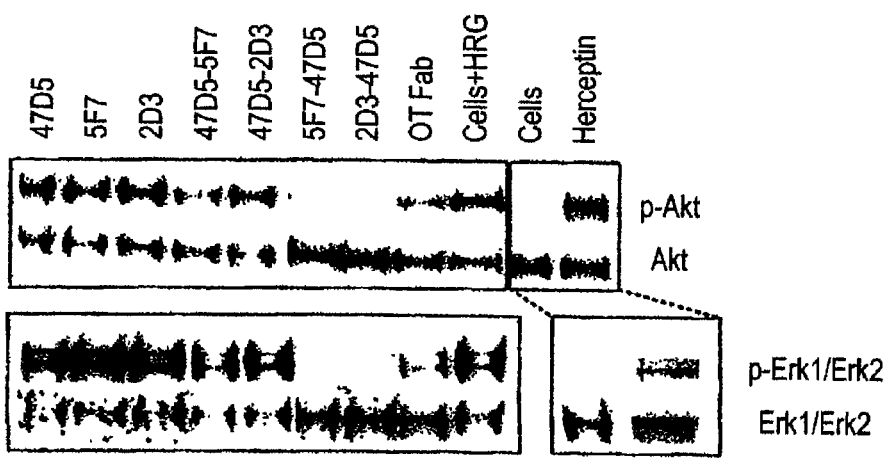
Figure 27J:
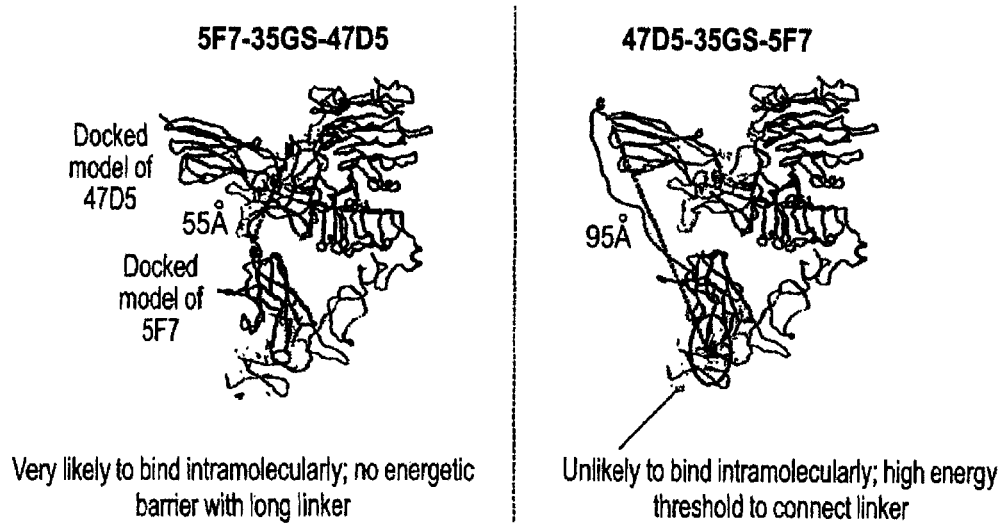

FIG. 26B: Ribbon view of the 5F7-linker-47D5 biparatopic construct for 2 linker lengths. The binding mode of the individual Nanobodies and the biparatopic constructs are shown. The HER-2 target is omitted for clarity. On the left side: a 35GS linker is used between the 2 Nanobodies and a very limited deviation from the individual binding modes is observed. On the right side: a 5GS linker is used and it can clearly been observed that both Nanobodies in the biparatopic construct significantly deviate from their optimal binding mode.

FIGS. 27A-K: Figures illustrating some of the preferred aspects and some of the advantages of the present invention, including the multiparatopic polypeptides of the invention.

EXAMPLES

Example 1

Procurement of the Extracellular Domain of HER2 for Use as Selection Antigen in Phage Display 1.1 Cloning of Extracellular HER2 Domain cDNA was isolated from SKBR3 breast cancer cells. The isolation of total RNA and cDNA synthesis was done according to standard protocols (Sambrook, Molecular cloning: Laboratory manual, $2^{nd}$ edition, Cold Spring Harbor Laboratory Press, Cold Spring Harbor, N.Y. (1989)). The coding sequence of the extracellular domain of the HER2 antigen was amplified by PCR using primer For-ErbB2 ECD; GCGAGCACCCAAGTGTGCACC (SEQ ID NO: 2392) and primer Rev-ErbB2 ECD: CTGCTCGGCGGGGCAGCCCTT (SEQ ID NO: 2393). The PCR construct was then cloned into the pCR4-TOPO cloning vector (Invitrogen, Paisley, UK). Clone 4 having the correct sequence was then amplified by PCR using primers (For-pST ErbB2 ECD: GGCGCGCCGACTACAAAGACGATGACGA-CAAGAGCACCCAAGTGTGCACC (SEQ ID NO: 2394) and Rev-pST ErbB2 ECD: CGGCTCGAGCTATTAAT-GAGAATGGTGATGGTGCTCGGCGGGGCAGCCCTT (SEQ ID NO: 2395)) that were designed to introduce restriction sites at the beginning and the end of the fragment encoding the HER2-ECD. The PCR product was then cloned via AscI and XhoI into the plasmid pSecTag-HygroA (Invitrogen, Paisley, UK). As such, the coding sequence of the HER2-ECD was fused in frame with the Ig-κ chain leader sequence at its N-terminal end followed by a Flag tag and a polyhistidine tag at the C-terminus. The sequence of different clones was determined by sequencing according to standard protocols.

1.2 Expression of the Extracellular Domain of HER2 in HEK 293 Cells, Purification of the Recombinant Protein Expression of the extracellular domain of HER2 was performed in HEK293T cells. HEK293T cells were seeded at $2 \times 10^6$ cells in 20 ml Dulbecco's Modified Eagle's Medium (DMEM) containing 10% FBS in T75 tissue culture flasks and allowed to adhere overnight. The next day, culture supernatant was removed and the cells were transiently transfected with purified pSecTag-HygroA plasmid DNA using Fugene-HD (Roche, Basel, Switzerland) as transfection agent. Cells were grown for an additional 72 h in DMEM containing 0.1% FBS, after which the culture supernatant was collected and filter-sterilized on a 0.22 µm filter (Millipore). The construct was then further purified out of the culture supernatant by immobilized metal affinity chromatography (IMAC) and size exclusion chromatography (SEC).

Detection of the recombinant protein was performed by ELISA. Maxisorp 96-well plate (Nunc, Wiesbaden, Germany) was coated with an anti-flag monoclonal antibody (Sigma Aldrich, Bornem, Belgium). Unspecific binding was blocked with 2% milk powder in PBS for 2 hours. All prior and subsequent washes were performed with PBS. Afterward, eluate fractions were incubated for 2 hours at room temperature, followed by incubation with Herceptin®. Detection of the recombinant HER2-ECD was performed with a horseradish peroxidase conjugated anti-IgG antibody (Jackson Immunoresearch Laboratories, Suffolk, UK). Development of the ELISA was performed with TMB substrate (Pierce, Rockford, Ill.) according to the specifications of the manufacturer

Example 2

Procurement of Omnitarg-Fab for Use as Competitive Agent in Phage Display and Screening Assays 2.1 Cloning of Omnitarg-Fab Omnitarg-Fab was constructed by gene assembly. The amino acid sequence of variable light and variable heavy chain of Omnitarg was derived from patents WO 2006/044908 and WO 2004/048525. The sequence was backtranslated and codon optimized using Leto 1.0 Gene optimization software (www.entechelon.com). Oligonucleotide primers for assembly of the variable light chain ($V_L$), variable heavy chain ($V_H$), constant light chain ($C_L$) and constant domain 1 of the heavy chain ($CH_1$) of the Omnitarg-Fab were designed (Tables C-5 and C-6) and assembly PCR performed. The introduced restriction sites SfiI and BsiWI for the $V_L$, KpnI and BstEII for the $V_H$, BsiWI and AscI for the $C_L$, and BstEII and NotI for the $CH_1$ were utilized for sequential cloning into an in-house expression vector derived from pUC119 which contained the LacZ promoter, a resistance gene for ampicillin or carbenicillin, a multicloning site and the gen3 leader sequence. In frame with the Omnitarg-Fab coding sequence, the vector coded for a C-terminal c-myc tag and a (His)6 tag. Oligonucleotide sequences were designed to have a 15 nucleotide overlap with 5' and 3' overlapping oligonucleotides. Three consecutive PCR overlap extension rounds were performed using Expand High fidelity PCR system (Roche, Basel, Switzerland) to obtain $V_L$, $V_H$, $C_L$ and $CH_1$ respectively. The obtained PCR fragments were cloned into the pCR4-TOPO cloning vector (Invitrogen, Paisley, UK). Plasmid. DNA was prepared from clones having the correct sequence. The fragments were isolated from the pCR4-TOPO cloning vector via restriction with the appropriate enzymes and extraction of the fragments from agarose gel. The fragments were then consecutively cloned into the in-house expression vector.

2.2 Expression of the Omnitarg-Fab in *E. coli* Cells, Purification of the Recombinant Protein The Omnitarg-Fab fragment was expressed in *E. coli* as His6-tagged protein and subsequently purified from the culture medium by immobilized metal affinity chromatography (IMAC) and size exclusion chromatography (SEC).

Omnitarg-Fab was biotinylated using EZ-Link Sulpho-NHS-LC-Biotin labeling kit according to the manufacturer's instructions (Pierce, Rockford, Ill.). Removal of free biotin was performed on Zeba Desalt Spin columns according to the manufacturer's instructions (Pierce, Rockford, Ill.).

Example 3

Identification of HER2 Binding Nanobodies 3.1 Immunizations

After approval of the Ethical Committee of the Faculty of Veterinary Medicine (University Ghent, Belgium), 2 llamas (121, 122) were immunized, according to standard protocols, with 6 intramuscular injections at biweekly intervals of SKBR3 human tumor cells which are derived from a breast tumor and contain an amplified HER2 gene and overexpress HER2 p185 tyrosine kinase (SKBR3; ATCC HTB-30; LGC Promochem, Middlesex, UK). Each dose consisted of approximately $5 \times 10^7$ freshly harvested SKBR3 cells.

3.2 Evaluation of Induced Responses in Llama

At day 0, 42 and 81 (time of PBL collection), sera were collected to evaluate the induction of immune responses in the animals against HER2 by ELISA. In short, 2 µg/ml recombinant human ErbB2/Fc chimera (rhErb2-Fc; R&D Systems, Minneapolis, Minn.) were immobilized overnight at 4° C. in a 96 well Maxisorp plate (Nuns, Wiesbaden, Germany). Wells were blocked with a casein solution (1% in PBS). After addition of serum dilutions, specifically bound immunoglobulins were detected using a goat anti-llama horseradish peroxidase conjugate (Bethyl Lab. Inc., Montgomery, Tex.), showing that for all animals a significant antibody dependent immune response against HER2 was induced (FIG. 1A). The antibody response was mounted both by the conventional and the heavy chain only antibody expressing B-cell repertoires since specifically bound immunoglobulins could be detected with antibodies specifically recognizing the conventional llama IgG1 antibodies (FIG. 1B) or the heavy-chain only llama IgG2 (FIG. 1C) and IgG3 (FIG. 1D) antibodies.

3.3 Library Construction

When an appropriate immune response was induced in llama, four days after the last antigen injection, a 150 ml blood sample was collected and peripheral blood lymphocytes (PBLs) were purified by a density gradient centrifugation on Ficoll-Paque™ (Amersham Biosciences, Uppsala, Sweden) according to the manufacturer's instructions. Next, total RNA was extracted from these cells and used as starting material for RT-PCR to amplify Nanobody encoding gene fragments. These fragments were cloned into a phagemid vector derived from pUC119 which contained the LacZ promoter, a coliphage pIII protein coding sequence, a resistance gene for ampicillin or carbenicillin, a multicloning site and the gen3 leader sequence. In frame with the Nanobody® coding sequence, the vector coded for a C-terminal c-myc tag and a (His)6 tag. Phage was prepared according to standard methods (see for example the prior art and applications filed by applicant cited herein) and stored after filter sterilization at 4° C. for further use.

3.4 Selections

Phage libraries obtained from llamas 121 and 122 were used for different selections.

In a first selection, ErbB2/Fc chimera (R&D Systems, Minneapolis, Minn., US) was coated onto Maxisorp 96-well plates (Nunc, Wiesbaden, Germany) at 20, 5 and 1 nM. Following incubation with the phage libraries and extensive washing, bound phage was aspecifically eluted with trypsin (1 mg/ml).

In a second selection, ErbB2/Fc chimera (R&D Systems, Minneapolis, US) was coated onto Maxisorp 96-well plates (Nunc, Wiesbaden, Germany) at 20 nM. Following incubation with the phage libraries and extensive washing, bound phage was specifically eluted with Herceptin® (Genentech, Roche).

In a third selection, soluble biotinylated ErbB2/Fc chimera was incubated with the phage libraries. After extensive washing, the biotinylated ErbB2/Fc was captured on a neutravidin coated solid phase. Bound phage was aspecifically eluted with trypsin (1 mg/ml).

In a fourth selection, soluble biotinylated ErbB2/Fc chimera was incubated with the phage libraries. After adding a 100-fold excess of non-labeled HER2, the biotinylated ErbB2/Fc was captured on a neutravidin coated solid phase. Bound phage was aspecifically eluted with trypsin (1 mg/ml).

In a fifth selection, phage libraries were incubated with Herceptin®-captured ErbB2/Fc. After extensive washing, bound phage was aspecifically eluted with trypsin (1 mg/ml)

In a sixth selection, soluble biotinylated ErbB2/Fc chimera was incubated with the phage libraries. After extensive washing, the biotinylated ErbB2/Fc was captured on a neutravidin coated solid phase. Bound phage was specifically eluted with Omnitarg-Fab.

In a seventh selection, phage libraries were incubated with Herceptin®-captured ErbB2/Fc. After extensive washing, bound phage was specifically eluted with Omnitarg-Fab.

In an eighth selection, phage libraries were incubated with biotinylated extracellular domain of HER2 captured on a neutravidin coated solid phase. After extensive washing, bound phage was specifically eluted with Omnitarg-Fab.

In a ninth selection, phage libraries were incubated with biotinylated extracellular domain of HER2 captured on a neutravidin coated solid phase. After extensive washing, bound phage was specifically eluted with Herceptin®.

In all selections, enrichment was observed. The output from each selection was recloned as a pool into an expression vector derived from pUC119 which contained the LacZ promoter, a resistance gene for ampicillin or carbenicillin, a multicloning site and the gen3 leader sequence. In frame with the Nanobody® coding sequence, the vector coded for a C-terminal c-myc tag and a (His)6 tag. Colonies were picked and grown in 96 deep-well plates (1 ml volume) and induced by adding IPTG for Nanobody expression. Periplasmic extracts (volume: ~80 µl) were prepared according to standard methods (see for example the prior art and applications filed by applicant cited herein).

Example 4

Detection and Isolation of HER2-Specific Heavy Chain Antibody Producing B-Cells

PBMC were isolated from peripheral blood samples from llamas immunized with HER2-Fc or SKBR3 human tumor cells using Ficoll density gradient centrifugation. These were then resuspended in cell culture medium and partially depleted from monocytes by adherence to the surface of plastic tissue culture T-flasks.

Next, non-adherent PBMC were collected from the flasks, washed with FACS buffer (PBS/10% FCS) at 4° C. and resuspended in the same ice-cold buffer. These were then stained using a combination of Alexa 488 labeled HER2-Fc (produced in-house, using Invitrogen (Paisley, UK) activated Alexa 488 and HER2-Fc recombinant protein from R&D Systems (Minneapolis, Minn.)), phycoerythrin labeled mouse-anti-llama IgG2 and -3 monoclonal antibodies (produced in-house, using purified phycoerythrin from Cyanotech, (Kailua-Kona, Hi.) crosslinked using the sulfo-SMCC heterobifunctional linker from Pierce-Endogen (Rochford, Ill.) to in-house produced and purified monoclonal antibodies originally described in Daley et al. (Clin. Diagn. Lab. Immunol. 2005, 12: 380)), Alexa 647 labeled mouse-anti-llama IgG1 monoclonal antibody (produced in-house), Alexa 647 labeled mouse-anti-llama monocyte and neutrophil antibody DH59B (purified antibody obtained from VMRD Inc. (Pullman, Wash.)) and dead cell specific dye TOPRO3 (Invitrogen, Paisley, UK). In some experiments, in-house Alexa 647 labeled recombinant human IgG1 Fc fragment (R&D Systems, Minneapolis, Minn.) was added to the stain combination as well.

Stained samples were washed thoroughly using cold FACS buffer and analyzed on a standard two-laser BD FACSAria cell sorter equipped with the ACDU microtiter plate single-cell deposition option (BD Biosciences, Franklin Lakes, N.J.). During acquisition and analysis, a gate was set on lymphocytes based on their forward/side scatter profile, which overlaps considerably with monocytes in llama. Doublet events were eliminated from acquisition and analysis by forward as well as side scatter pulse processing, eliminating all events which might be originating from more than one cell. Dead cells, monocytes and B-cells expressing conventional antibody on their cell membrane were removed from further analysis by gating out all remaining events having fluorescence over background (unstained PBMC) in the Alexa647/TOPRO3 channel. In some experiments, Alexa 647 labeled recombinant Fc fragment was used to stain the PBMC additionally. In these experiments, B-cells producing antibody binding Fc were also rejected from analysis and sorting by similar Alexa 647 channel exclusion, so as to avoid isolation of B-cells binding the Fc region of the fusion protein. In the phycoerythrin channel. B-cells displaying heavy chain antibody on their cell membrane could be clearly differentiated from any other remaining lymphocyte-type cells, and another gate was set on this population. Lastly, antigen-binding heavy chain IgG expressing B-cells cells were detected as a discrete high fluorescence intensity peak population in the Alexa 488 channel histogram distinct from the main population being no more fluorescent in this channel than when no Alexa 488 labeled antigen was added. Individual antigen binding B-cells were collected in separate wells of 96-well PCR plates in the ACDU, using DiVa software predefined stringent single-cell sorting criteria to avoid any double-cell droplet or adjacent-droplet double cell sorting. Typically, only 1-5% of heavy chain B-cells were found to bind antigen.

Example 5

Amplification and Cloning of HER2-Specific Heavy Chain Antibody Variable Regions Individual B-cells expressing heavy chain antibodies binding HER2-Fc or the HER2 region of the fusion protein specifically were sorted into 96-well plates containing 40 µl of RT-PCR buffer (Superscript III One-step RT-PCR kit, Invitrogen, Paisley, UK) per well, as described in Example 5, and stored at −80° C. For variable region gene sequence recovery, plates were thawed at room temperature and a mix of NP-40 (Roche Applied Sciences, Indianapolis, Ind.), gene specific 5' and 3' primers and RT-PCR enzyme mix were added to a total volume of 50 microliter per well by an automated liquid handler (Tecan, Männedorf, Switzerland). After reverse transcription and first PCR amplification in a standard thermal cycler, a 2 microliter aliquot was removed from all wells and amplified in a nested PCR reaction using a proof-reading thermostable polymerase, or blend of polymerases containing at least one proof-reading enzyme. The 5' nested primer contains the nucleotide sequence required for directional TOPO cloning (Invitrogen, Paisley, UK). The 3' primer is designed to allow for the in-frame fusion of variable region gene framework 4 to vector encoded detection (c-myc) and purification (6His) peptide tags. Amplicons were detected from individual wells using ethidium bromide stained agarose gels and/or in microtiter plates via PicoGreen DNA binding fluorescent dye assay (Invitrogen, Paisley, UK). Typically, up to 60% of wells contained a single and sharply defined amplification product, whereas control wells in the same plate not having received any cells were completely devoid of amplification product.

The amplicons from nested PCR wells containing detectable product were then ligated into an E. coli expression vector in a homogeneous ligation reaction, by mixing an aliquot of unpurified PCR mix with a topoisomerase-activated expression vector (in-house developed IPTG inducible E. coli Nanobody expression vector, adapted to allow directional TOPO cloning by Invitrogen's custom services department). The ligation mixture was then pipetted onto electrocompetent E. coli cells pre-aliquotted in a 96-well format electroporation chamber array (BTX Products of Harvard Apparatus, Holliston, Mass.), and cells were transformed by electroporation using a BTX pulse generator.

Transformation mix was spread on selective agarose, multiple individual subcolonies picked and grown in 96-well deep well plates containing liquid selective medium by a QP Expression colony picker/rearrayer system (Genetix, New Milton, Hampshire, UK).

Periplasmic extracts (volume: ~80 µl) were prepared according to standard methods (see for example the prior art and applications filed by applicant cited herein).

Example 6

Anti-HER2 Nanobodies Recognize Extracellular HER2 Domain

Periplasmic extracts of individual Nanobodies were screened for HER2 specificity by ELISA on solid phase coated ErbB2/Fc chimera (R&D Systems, Minneapolis, Minn.). Detection of Nanobody fragments bound to immobilized recombinant HER2 antigen was carried out using an in house made mouse anti-myc antibody (2 mg/ml) detected with alkaline phosphatase-conjugated anti-mouse IgG (Sigma Aldrich, Bornem, Belgium). The signal was developed by adding PNPP substrate solution and detected at a wavelength of 405 nm. FIG. 2 is illustrative of typical ELISA results, showing a high hit rate of positive clones.

Sequences of different HER2 binding clones are depicted in Tables B-1, B-2 and B-3. Alignment of the different HER2 binding clones based on CDR3 similarity is depicted in Table C-1.

Example 7

Anti-HER2 Nanobodies Recognize Cell Surface Exposed Receptor Epitopes

To verify whether the Nanobodies are able to recognize cell surface expressed HER2, binding to breast cancer tumor cell line SKBR3 was assessed by flow cytometry. Cell binding assays were carried out by initially incubating 200,000 cells with Nanobody-containing periplasmic preparation obtained in Examples 3 and 5 or relevant controls. After incubation, the cells were washed with FACS buffer. Cells were subsequently incubated successively with an in-house mouse anti-myc-tag monoclonal antibody and phycoerythrin labeled goat anti-mouse F(ab')$_2$ fragments (Jackson ImmunoResearch, Suffolk, UK). To omit signals arising from dead cells, a TOPRO-3 (Invitrogen, Paisley, UK) staining was carried out. Cells were finally analyzed on a BD FACSArray Bioanalyzer System (BD Biosciences, Franklin Lakes, N.J., US).

FIG. 3 depicts binding of several Nanobody constructs to SKBR3 cells as measured by flow cytometric analysis. It can be seen that the constructs 2A1, 2A3, 2C3, 2C5, 2D3 and 2G4 show clearly discernable shifts in fluorescence intensity as compared to the fluorescence intensity for cells incubated only with FACS buffer in the absence of any construct but with all appropriate detection agents as used for the detection of Nanobody constructs.

Example 8

Screening for Nanobodies that Compete with Herceptin® for HER2 Binding

A competition ELISA was performed to screen for Nanobodies that are able to inhibit the Herceptin® interaction with HER2. In this competition ELISA, the binding of 2 nM Herceptin® to SKBR3 vesicles was evaluated in the presence of a ½0 dilution of Nanobody containing periplasmic extract obtained in the second selection described in Example 3. FIG. 4 shows an example of this competitive ELISA, identifying several clones that compete with binding of Herceptin® to HER2 expressed on SKBR3 vesicles.

Periplasmic extracts obtained in the second and ninth selection described in Example 3 and periplasmic extracts obtained in Example 5, were also screened in a Herceptin®-competitive homogeneous cell-based assay to evaluate the capacity of the expressed Nanobodies to block Herceptin® binding to HER2. The FMAT 8200 HTS system (Applied Biosystems, Foster City, Calif.) assay was performed as follows: SKBR3 cells expressing HER2 were grown in tissue culture flasks, collected and washed with screening buffer (PBS, 10% FCS) and resuspended in screening buffer at a concentration of $2.5 \times 10^5$ cells/ml. Alexa 647-labeled Herceptin® was diluted to 62.5 ng/ml in screening buffer. Periplasmic extracts were diluted in screening buffer to obtain final dilutions of 4, 10, 40, 100, 200 and 400. To initiate the competitive screen, 10 µl labeled Herceptin®, 10 µl periplasmic dilution and 20 µl of cells were added to each well of FMAT system 384-well plates (PE Biosystems, Foster City, Calif.) The plates were scanned after 2 hours of incubation. A well was considered positive if it had a count of over 50 events. Screening of the extracts in this Herceptin® competitive homogeneous cell-based assay identified several clones (SEQ ID NOs: 2051-2113) that can block the binding of Herceptin® to HER2 with more than 90% (FIG. 5).

Purified Nanobodies were tested for inhibition of binding of Alexa647-labeled Herceptin® to HER2 expressed on SKBR3 cells. Serial dilutions of purified Nanobody (concentration range: 20 nM-10 pM) were added to SKBR3 cells together with $4 \times 10^{-10}$M Alexa647-labeled Herceptin® and incubated for 2 hours, after which plates were scanned. Herceptin® was included as reference (MoAb). Results are shown in FIG. 6. Dose-response curves were observed for all Nanobodies with $IC_{50}$-values ranging from 40 pM to 200 pM.

Example 9

Screening for Nanobodies that Compete with Omnitarg-Fab for HER2 Binding

Periplasmic extracts obtained in the sixth and seventh selection described in Example 3, were screened in an Omnitarg-Fab (OT-Fab) competitive homogeneous cell-based assay to evaluate the capacity of the expressed Nanobodies to block OT-Fab binding to HER2. The FMAT 8200 HTS system (Applied Biosystems, Foster City, Calif.) assay was performed as follows: SKBR3 cells expressing HER2 were grown in tissue culture flasks, collected and washed with screening buffer (PBS, 10% FCS) and resuspended in screening buffer at a concentration of $2.5 \times 10^5$ cells/ml. Biotinylated OT-Fab was diluted in screening buffer to obtain a final concentration of 0.586 nM. The periplasmic extracts were diluted in screening buffer to obtain final dilutions of 100. To initiate the competitive screen, 5 µl labeled OT-Fab, 10 µl periplasmic dilution, 5 µl. FMAT Blue dye-labeled streptavidin (100 ng/ml) and 20 µl of cells were added to each well of FMAT system 384-well plates (PE Biosystems, Foster City, Calif.). The plates were scanned after 2 hours of incubation. A well was considered positive if it had a count of over 50 events. Screening of the extracts in this OT-Fab competitive homogeneous cell-based assay identified clones that can block the binding of OT-Fab to HER2 with more than >90% (FIG. 7). Sequence analysis showed that all clones that blocked binding of OT-Fab HER2 are identical and represent a single Nanobody (SEQ ID NO: 2114).

Example 10

Screening of Kinetic Off-Rate Constants Via Surface Plasmon Resonance (BIAcore)

RhErbB2-Fc was immobilized on a CM5 sensor chip surface docked in Biacore 3000. Approximately 3600RU of rhErbB2-Fc was immobilized. Experiments were performed at 25° C. Periplasmic extracts were diluted 10-fold in running buffer (HBS-EP). The samples were injected for 1 min at a flow rate of 45 µl/min over the activated and reference surfaces. Those surfaces were regenerated with a 3 s pulse of glycine-HCl µl-11.5+0.1% P20. As an example, the off rate ($k_{off}$) of different Nanobodies is documented in Table C-2.

Example 11

Anti-HER2 Nanobodies can Block SKBR3 Cell Proliferation

The growth inhibitory characteristics of isolated Nanobodies were evaluated using the breast tumor cell line SKBR3. Briefly, SKBR3 cells were detached using 0.25% (vol/vol) trypsin and suspended in Dulbecco's Modified Eagle's Medium (DMEM) supplemented with 10% fetal calf serum (FCS), glutamine, and penicillin-streptomycin at a density of $1 \times 10^5$ cells/ml. Aliquots of 200 µl ($2 \times 10^4$ cells) were plated into 96-well microdilution plates and allowed to adhere. After overnight adherence, cells were washed with serum-free medium and starved for 4 hours in 100 µl serum-free medium. Then, 100 µl of 1% FCS containing medium alone or medium containing Nanobody (final concentration of 50 nM) was added. After 2 days of incubation, cells were pulsed with 1 µCi [³H]-thymidine and incubated for an additional 24 h prior to freezing at −80° C. Cells were subsequently thawed and embedded on glass fiber membranes using a cell harvester (Perkin Elmer Life Sciences, Wellesley, Mass., USA). After several washings with water, filters were air-dried and counted using a γ-counter (Perkin Elmer Life Sciences). Nanobody 2A5 inhibited SKBR3 proliferation by about 18%. Up to 30% or more inhibition was achieved with Nanobodies 2C3, 2D3, 2A4 and 5F7 (FIG. 8).

Example 12

Generation of Multivalent/Multispecific Nanobody Formats

To potentially increase the biological effect of Nanobody molecules, bivalent constructs were fused head-to-tail using a GGGGSGGGS linker.

Here we describe the construction and characterization of bivalent Nanobodies consisting of two identical anti-HER2 molecules all separated by a 9 (GS) amino acid linker peptide. DNA segments encoding Nanobodies 2A4, 2A5, 2C3, 2D3, 5F7 were head-to-tail fused resulting in constructs 2A4-9GS- 2A4, 2A5-9GS-2A5, 2C$_{3-9}$GS-2C3, 2D3-9GS-2D3, 5F7-9GS-5F7. Sequences of these bivalent constructs are listed in Table B-4. All Nanobodies were expressed in *E. coli* and purified according to standard protocols (see for example the prior art and applications filed by applicant cited herein).

The different bivalent Nanobody formats were screened in a Herceptin®-competitive homogeneous cell-based assay to evaluate their capacity to block Herceptin® binding to HER2 compared to their monovalent format. Briefly, 10 µl labeled Herceptin® (62.5 ng/ml), 10 µl Nanobody dilution and 20 µl of cells (5×10$^3$ cells) were added to each well of FMAT system 384-well plates (PE Biosystems, Foster City, Calif.). The plates were scanned after 2 hours of incubation. FIG. 9 shows that the bivalent constructs are more efficient in blocking the binding of Herceptin® to HER2-expressing SKBR3 cells as compared to their monovalent formats.

To test whether selected Nanobodies have potential as anti-cancer agents in an animal model, a strategy to increase the serum half life is preferred (as for example described in patent application WO 04/041865), since the serum half life of a mono- or bivalent Nanobody (approximately 15 or 30 KDa, respectively) is not optimal for this therapeutic indication. Human serum albumin specific Nanobody ALB1 (SEQ ID NO: 2391), cross reactive with mouse serum albumin, was chosen. Here we describe the construction of bispecific Nanobodies consisting an anti-HER2 Nanobody and ALB1, all separated by a 9 (GS) amino acid linker peptide and resulting in constructs 2A4-9GS-ALB1, 2A5-9GS-ALB1, 2C3-9GS-ALB1, 2D3-9GS-ALB1 and 5F7-9GS-ALB1. Sequences of these bispecific constructs are given in Table B-5.

To test whether the HER2-binding Nanobodies as disclosed herein above retain their biological activity in a more complicated molecular context such as a bispecific format, Nanobody formats were screened in a Herceptin®-competitive homogeneous cell-based assay to evaluate their capacity to block Herceptin® binding to HER2 compared to their monovalent and bivalent format. Based on the results shown in FIG. 9, it can be concluded that fusion of a Nanobody with different antigen specificity to a HER2-binding Nanobody does not affect the potency of the latter.

Example 13

Generation of Biparatopic Formats Combining a Herceptin®-Competing Nanobody with a Library of HER2 Binding Nanobodies The structural requirement for multispecificity is to fuse two or more binding domains together, with sufficient flexibility to allow simultaneous binding to different target epitopes. The simplest bispecific is one that binds to two different and non-overlapping epitopes on the same target in such a way that simultaneous binding to the target is possible. Robert et al (Int. J. Cancer 1995, 28; 62(3): 283-90) have described the design of high avidity biparatopic antibodies directed against two different epitopes of the carcinoembryonic antigen. Binding of both arms simultaneously without a significant loss of entropy will endow 'biparatopic' antibodies with increased avidity and hence, increased binding affinity to the target. As a result, higher potency can be obtained as well as enhanced selectivity. In addition, careful selection of the epitopes targeted on the antigen by the biparatopic antibody or fragment thereof, combined with rational design of linkers to allow maximal flexibility of the two binding domains within the biparatopic antibody, may for example result in the blocking of two or more critical interaction sites of the target, leading to improved potency.

Using genetic fusion, one Herceptin®-competing Nanobody was combined with a repertoire of HER2-binding Nanobodies and this mini-repertoire was screened for biparatopics with improved binding activity and tumor cell growth inhibitory characteristics compared to the monovalent Herceptin®-competing Nanobody.

13.1 Construction of an Expression Vector for Biparatopic Design

For the construction of biparatope Nanobodies, an expression vector was adapted to contain the Herceptin®-competitive Nanobody 2D3 (which was shown to block cell proliferation between 20-30% as monovalent format (see Example 11) and which strongly competes with Herceptin® for binding to HER2-overexpressing SKBR3 cells) to which other Nanobodies with different HER2-binding specificities can be fused, spaced by a linker (FIG. 10). For the design of this vector, a 35 GS linker was used but other linker lengths can also be used to allow flexibility between the two building blocks. The 2D3 Nanobody is placed at the C-terminal end of the construct to allow SfiI-BstEII cloning of a full selection output. Alternatively, the 2D3 Nanobody can also be placed at the N-terminal end of the construct to allow cloning of a full selection output at the C-terminal end.

13.2 Generation of a Biparatopic Library

A full selection output retrieved from a selection on Herceptin®-captured rhErbB2/Fc followed by trypsin elution (Example 3.4), was unidirectionally cloned to the 2D3 Nanobody. Sequence analysis of a selected number of individual colonies derived from the selection output showed a good diversity in the repertoire: 16 Nanobody families were identified in 72 sequences. The ligation mix was transformed into *E. coli* cells and the transformation mix spread on selective agarose. Multiple individual subcolonies were picked and grown in 96-well deep well plates containing liquid selective medium by a QP Expression colony picker/rearrayer system (Genetix, New Milton, Hampshire, UK). Forty-eight individual colonies were sequenced and analyzed. From 32 annotated sequenced, eight different Nanobody families were identified.

Periplasmic extracts (volume: ~80 µl) were prepared according to standard methods (see for example the prior art and applications filed by applicant cited herein). The biparatopic Nanobodies were purified from the periplasmic extracts using PhyTip200$^+$ columns (Phynexus, San Jose, Calif.) by a Tecan Evo Robotic system (Promega, Madison, US) and analyzed for their effects on SKBR3 tumor cell proliferation.

13.3 Effect of Biparatopic Nanobodies on SKBR3 Cell Proliferation

The growth inhibitory characteristics of Nanobodies purified from periplasmic extracts by PhyTip200$^+$ were evaluated using the breast tumor cell line SKBR3. Briefly, SKBR3 cells were detached using 0.25% (vol/vol) trypsin and suspended in DMEM supplemented with 10% fetal calf serum (FCS), glutamine, and penicillin-streptomycin at a density of 1×10$^5$ cells/ml. Aliquots of 200 µl (2×10$^4$ cells) were plated into 96-well microdilution plates and allowed to adhere. After overnight adherence, cells were washed with serum-free medium and starved for 4 hours in 100 µl serum-free medium. Then, 100 µl of 1% FCS containing medium alone or 90 ml of 1% FCS containing medium with 10 µl PhyTip200$^+$ purified periplasmic extract or 50 nM Herceptin® was added. After 2 days of incubation, cells were pulsed with 1 µCi [$^3$H]-thymidine and incubated for an additional 24 h prior to freezing at −80° C. Cells were subsequently thawed and embedded on glass fiber membranes using a cell harvester (Perkin Elmer Life Sciences, Wellesley, Mass., USA). After several washings with water, filters were air-dried and counted using a γ-counter (Perkin Elmer Life Sciences).

Herceptin® was able to inhibit cell proliferation of SKBR3 up to 50%. Different subclasses of biparatopic Nanobodies were identified: a group of biparatopic Nanobodies revealed an inhibitory effect on the ErbB2 overexpressing cell line SKBR3 to a lower extent than Herceptin®, a second group of biparatopic Nanobodies increased cell proliferation and a third group of biparatopic Nanobodies was able to inhibit cell proliferation of SKBR3 cells to an equal or greater extent than Herceptin®. FIG. 11 shows an example of this 'single hit' cell proliferation assay.

Example 14

Characterization of Biparatopic Nanobodies

The biparatopic molecules 28F6-35GS-2D3, 28G5-35GS-2D3, 29E9-35GS-2D3, 30D10-35GS-2D3, 27A5-35GS-2D3, 31D11-35GS-2D3, 30E10-35GS-2D3, 27A3-35GS-2D3, 27B7-35GS-2D3, 27C3-35GS-2D3, 27D1-35GS-2D3, 27E4-35GS-2D3, 27E7-35GS-2D3, 27H3-35GS-2D3, 27H4-35GS-2D3, 27H5-35GS-2D3 were expressed in *E. coli* as c-myc, His6-tagged proteins and subsequently purified from the culture medium by immobilized metal affinity chromatography (IMAC) and size exclusion chromatography (SEC). A control biparatopic Nanobody consisting of a dummy (i.e. not binding to HER2) Nanobody genetically fused to the 2D3 Nanobody, spaced by a 35GS linker was used as a control.

14.1 Biparatopic Nanobodies Display Improved Binding to HER2 as Compared to the Monovalent Building Blocks The off-rate of the biparatopic Nanobodies was determined by surface plasmon resonance on a Biacore 3000 instrument. In brief, rhErbB2-Fc was immobilized on a CM5 sensor chip surface docked in Biacore 3000. Approximately 3600RU of rhErb B2-Fc was immobilized. Experiments were performed at 25° C. Nanobody binding was assessed at various concentrations. The samples were injected for 1 min at a flow rate of 45 μl/min over the activated and reference surfaces to allow for binding to chip-bound antigen. Next, binding buffer without Nanobody was sent over the chip at the same flow rate to allow for dissociation of bound Nanobody. After 10 min, remaining bound analyte was removed by injecting regeneration solution (Glycine/HCl pH1.5).

The monovalent 2D3 and biparatopic dummy-2D3 Nanobodies had similar off-rates in the range of 1E-3 1/s, indicating that fusion of a Nanobody to the N-terminal end of 2D3 does not interfere with binding of the latter (FIG. 12). The off-rate of bivalent 2D3-35GS-2D3 is in the range of 1E-4 1/s, indicating simultaneous binding of the two Nanobodies.

The off-rate of the biparatopic constructs 2B7-35OS-2D3, 27C3-35GS-2D3 and 27H5-35GS-2D3 are in the range of 1E-3 1/s (FIG. 13). These off-rates and the binding responses indicate binding by the 2D3 paratope, but lack of binding by the other paratope, either by non-specificity for rhErb2 or an extremely much lower affinity for rhErb2 compared to 2D3 or by sterical hindrance of the epitope by the Fc part or by the altered conformation after the immobilization procedure on the CM5 sensor chip.

Off-rates of the biparatopic constructs 2D3-35GS-2D3, 27D1-35GS-2D3, 27A3-35GS-2D3, 27E7-35GS-2D3 are in the range of 1E-4 1/s (FIG. 14). These off-rates indicate simultaneous binding of the 2 paratopes.

14.2 Herceptin®-Competitive Behavior of Biparatopic Nanobodies

Figure 15A:
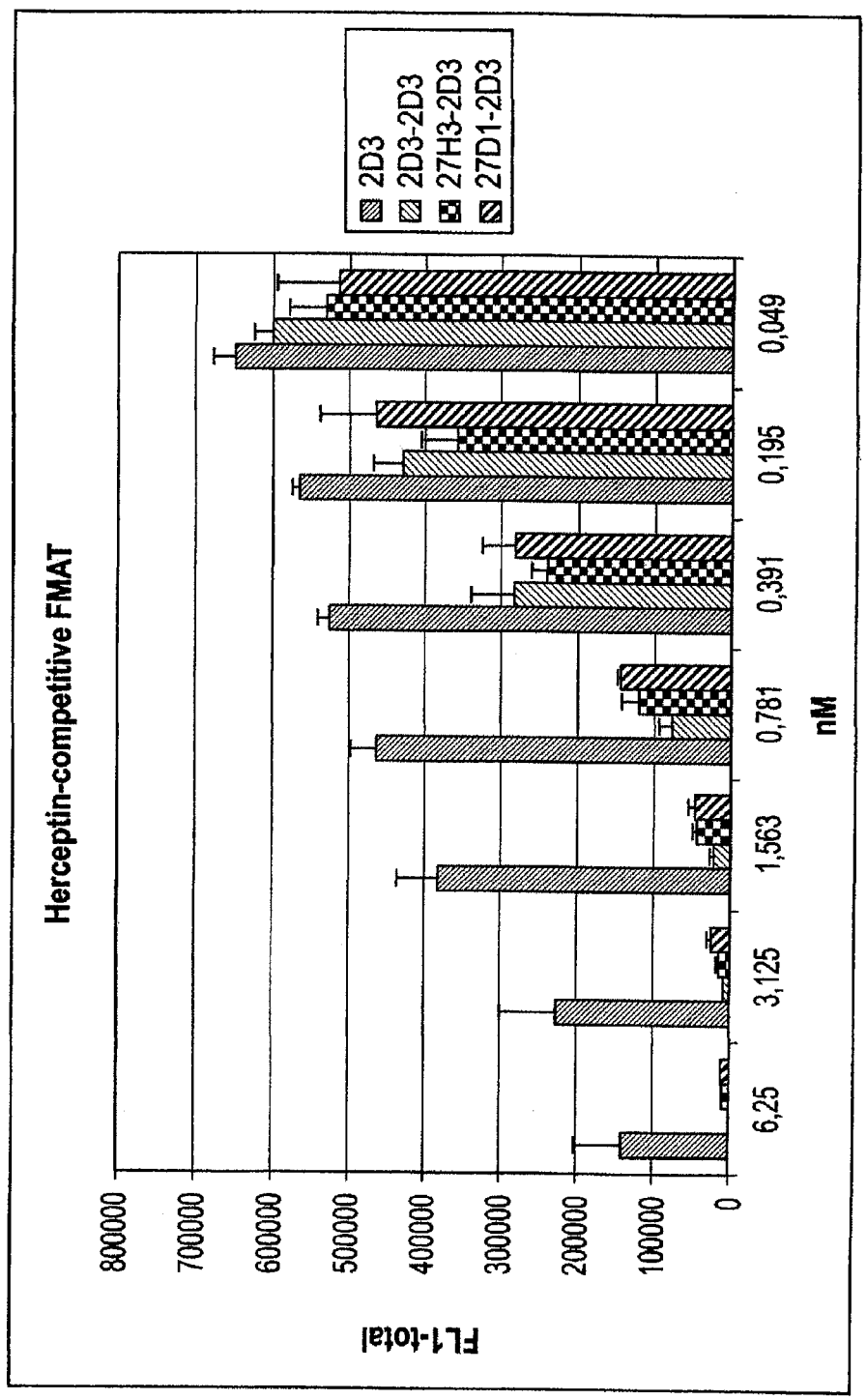
Figure 15B:
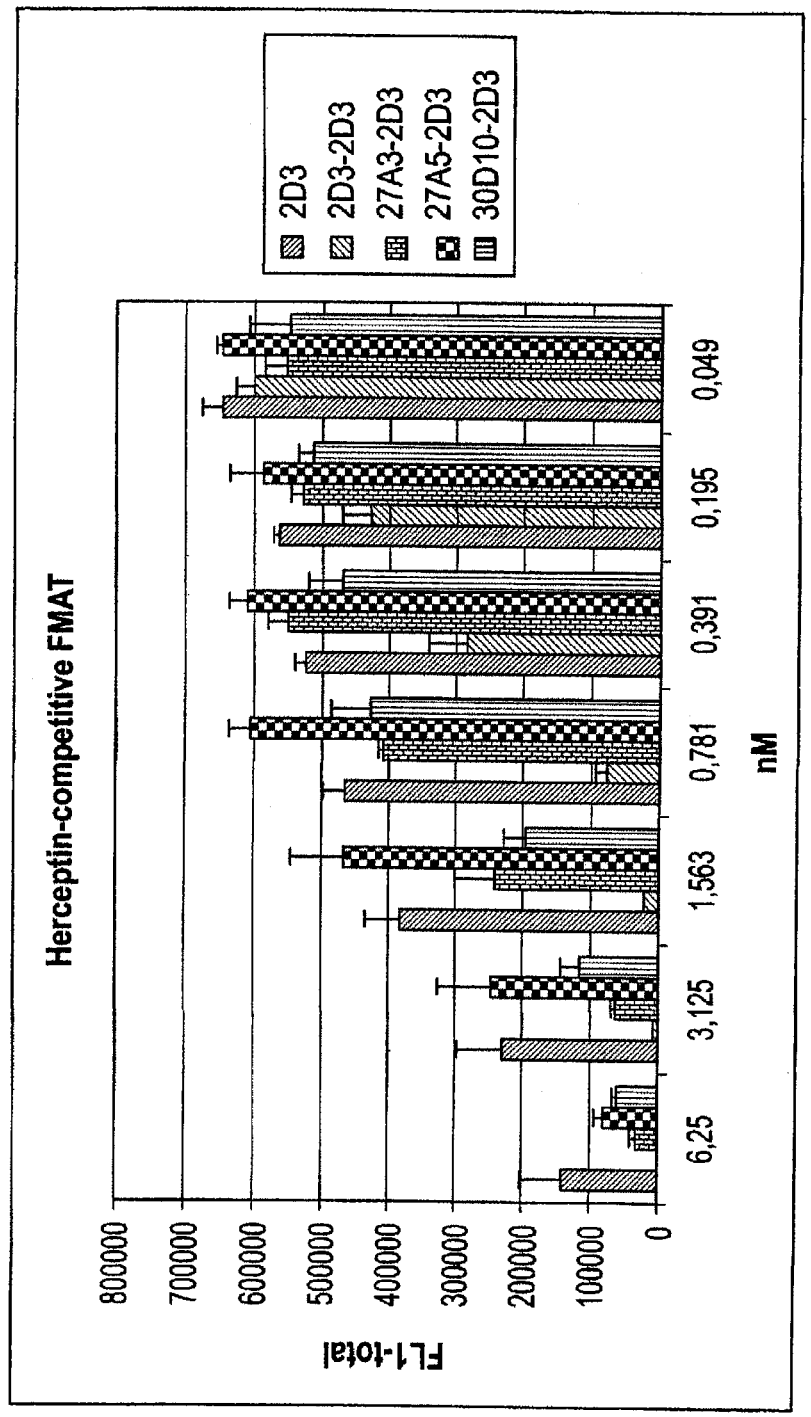
Figure 15C:
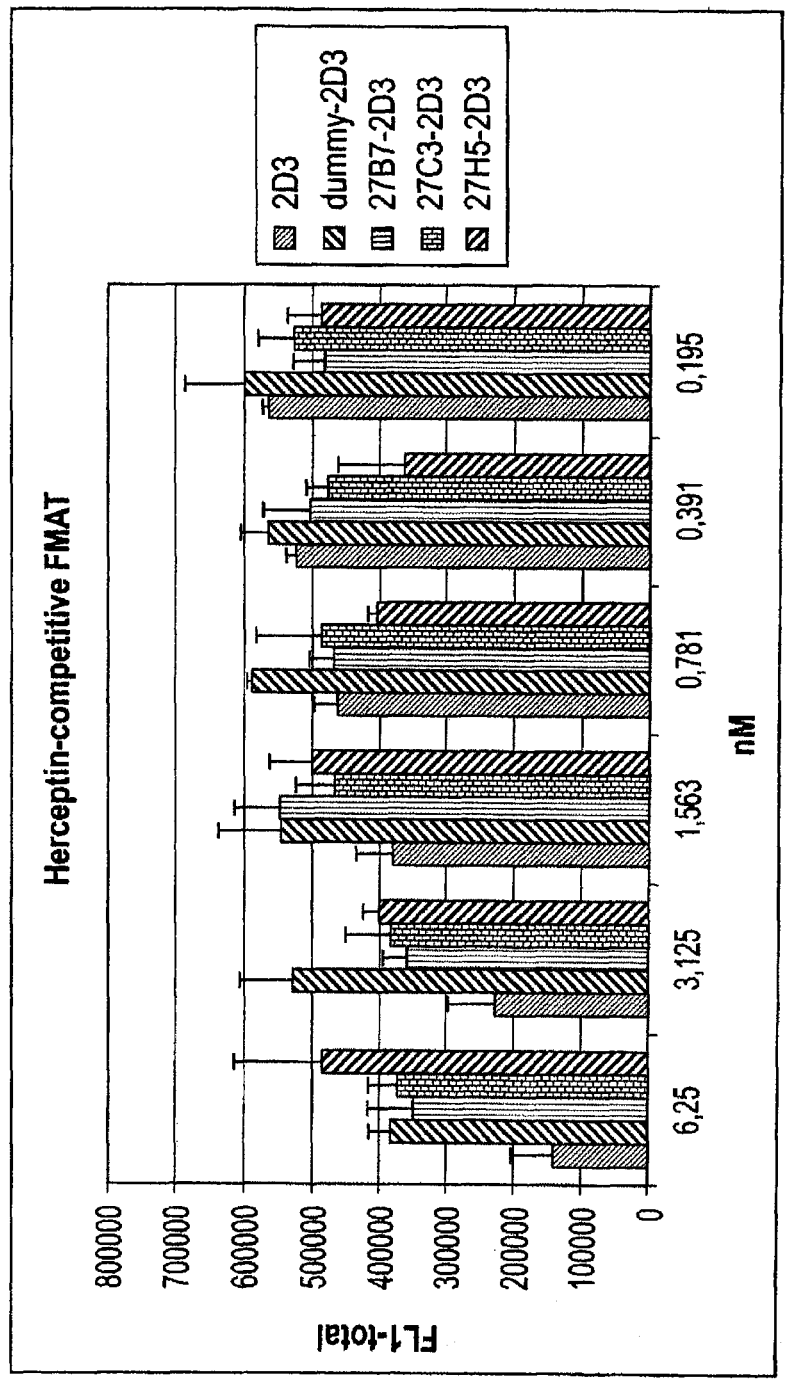

Biparatopic Nanobodies were screened in a Herceptin®-competitive homogeneous cell-based assay to evaluate the capacity of the expressed Nanobodies to block Herceptin® binding to HER2. The FMAT 8200 HTS system (Applied Biosystems, Foster City, Calif.) was used as described in Example 8. Bivalent 2D3-35GS-2D3 Nanobody more efficiently blocks binding of Herceptin® to HER2 as compared to monovalent 2D3 (FIGS. 15A and B). Likewise, biparatopic Nanobodies 27H3-35GS-2D3 and 27D1-35GS-2D3 block binding of Herceptin® to HER2 expressed on SKBR3 cells more efficiently than monovalent 2D3. Nanobodies 27A3, 27A5 and 30D10 have no influence on the Herceptin®-competitive characteristic of Nanobody 2D3 when fused to its N-terminal end, spaced by a 35GS linker (FIG. 15B). Finally, Nanobodies 27B7, 27C3, 27H5 and the dummy Nanobody have an inhibitory effect on the Herceptin®-competitive potential of 2D3 (FIG. 15C).

14.3 Competitive Binding of Biparatopic Nanobodies with Omnitarg-Fab to HER2.

Biparatopic Nanobodies were screened in an Omnitarg-Fab competitive homogeneous cell-based assay to evaluate the capacity of the expressed Nanobodies to block Omnitarg-Fab binding to HER2. The FMAT 8200 HTS system (Applied Biosystems, Foster City, Calif.) was used as described in Example 9. Biparatopic Nanobodies 2D3-35GS-2D3, 27H3-35GS-2D3, 27D1-35GS-2D3, 27A3-35GS-2D3, 27A5-35GS-2D3 and 30D10-35GS-2D3 did not efficiently block the binding of biotinylated Omnitarg Fab (FIG. 16). Non-labeled Omnitarg-Fab inhibited binding of biotinylated Omnitarg-Fab in a dose-dependent manner.

Example 15

Biparatopic Nanobodies Comprising a Herceptin®-Competitive and a HER2-Binding Nanobodies Inhibit SKBR3 Cell Proliferation The growth inhibitory characteristics of biparatopic Nanobodies were evaluated using the breast tumor cell line SKBR3. Briefly, SKBR3 cells were detached using 0.25% (vol/vol) trypsin and suspended in DMEM supplemented with 10% fetal calf serum (FCS), glutamine, and penicillin-streptomycin at a density of $1 \times 10^5$ cells/ml. Aliquots of 200 μl ($2 \times 10^4$ cells) were plated into 96-well microdilution plates and allowed to adhere. After overnight adherence, cells were washed with serum-free medium and starved for 4 hours in 100 μl serum-free medium. Then, 100 μl of 1% FCS containing medium alone or 90 μl of 1% FCS containing medium with serial dilutions of IMAC/SEC purified biparatopic Nanobodies, monovalent 2D3 or 50 nM Herceptin® was added. After 2 days of incubation, cells were pulsed with 1 μCi [$^3$H]-thymidine and incubated for an additional 24 h prior to freezing at −80° C. Cells were subsequently thawed and embedded on glass fiber membranes using a cell harvester (Perkin Elmer Life Sciences, Wellesley, Mass., USA). After several washings with water, filters were air-dried and counted using a γ-counter (Perkin Elmer Life Sciences).

Biparatopic Nanobodies are able to inhibit cell proliferation of SKBR3 cells to an equal or greater extent than Herceptin®. FIG. 17 shows an example of this cell proliferation assay.

Example 16

Biparatopic Nanobodies Comprising a Herceptin®-Competitive and a HER2-Binding Nanobody Inhibit AKT Signal Transduction in SKBR3 Breast Cancer Cells Upon overexpression, HER2 may be activated by homodimerisation. HER2 plays a major regulatory role in the signalling network involved in many cellular processes, including the p21Ras/Mitogen-Activated Protein Kinase (MAPK) and PI3K/AKT pathways. Treatment of HER2 overexpressing SKBR3 cells with Herceptin® results in reduction in HER2 phosphorylation which is linked to inhibition of AKT phosphorylation.

To assess the effect of biparatopic Nanobodies on the AKT pathway in SKBR3 cells, cells were plated in 2% serum containing medium in 24-well culture plates. The next day, medium was refreshed and 50 nM of either biparatopic Nanobody, Herceptin®, monovalent 2D3 Nanobody or medium alone was added and incubated for 16 h. The reaction was stopped by aspirating the cell medium. Cells were lysed by addition of lysis buffer (20 mM NP40, 20 mM Tris-HCl pH8, 10% glycerol, 2 mM EDTA, 1 mM sodium orthovanadate, complete protease inhibitor cocktail, 1% PBS). Protein concentration in the lysates was measured using BCA protein assay kit (Pierce) according to the manufacturer's indications. Equal amounts of protein were run on 10% polyacrylamide gels and electroblotted onto Invitrolon PVDF membranes (Invitrogen, Paisley, UK). The presence of phosphorylated AKT was assessed by probing the blots with Phospho-AKT (Ser473) antibody (Cell Signaling, Danvers, Mass.) and total AKT was detected using AKT antibody (Cell Signaling). The blots were visualized using a chemiluminescent substrate (Perkin Elmer, Wellesley, Mass., USA).

As shown in FIG. 18, biparatopic Nanobodies 27A5-35GS-2D3 and 27A3-35GS-2D3 significantly block AKT activation in SKBR3 cells, whereas dummy-2D3 biparatopic and monovalent 2D3 Nanobody do not have a visible effect on AKT signalling.

Example 17

Construction of Biparatopic Nanobodies Combining Herceptin®- and Omnitarg Competitive Nanobodies For the construction of biparatopics consisting of a Herceptin®-competitive and Omnitarg-competitive Nanobody, the expression vector described in Example 13.1 was used. Herceptin®-competitive Nanobodies 2D3 and 5F7 were cloned either at the C-terminal or N-terminal end of Omnitarg-competitive Nanobody 47D5, spaced by a 35GS linker. Biparatopic Nanobodies 2D3-35GS-47D5, 47D5-35GS-2D3, 5F7-35GS-47D5 and 47D5-35GS-5F7 were expressed in E. coli as c-myc, His6-tagged proteins and subsequently purified from the culture medium by immobilized metal affinity chromatography (IMAC) and size exclusion chromatography (SEC). Two control biparatopic Nanobody consisting of a dummy Nanobody genetically fused to the 2D3 or 47D5 Nanobody, spaced by a 35GS linker were used as controls.

Example 18

Characterization of Biparatopic Formats Combining Herceptin®- and Omnitarg Competitive Nanobodies 18.1 Biacore Analysis A kinetic analysis for 2D3, 5F7 and 47D5 was performed on Biacore to determine the binding affinity to HER2. In addition, the influence of a dummy Nanobody fused to the N-terminal end of 2D3 and 47D5 on the binding characteristics of the latter to HER2, was analyzed. rhErbB2-Fc was immobilized on a CM5 sensor chip surface docked in T100. Approximately 3600RU of rhErbB2-Fc was immobilized. Experiments were performed at 25° C. Different concentrations of Nanobody (100 nM-0.78 nM) were made in running buffer (HBS-EP). The samples were injected for 1 min at a flow rate of 45 µl/min over the activated and reference surfaces.

In Table 2 an overview of $k_d/k_{off}$, $k_a$, and $K_d$ values for the Nanobodies is shown. Fusion of a Nanobody at the N-terminal end of the Nanobodies 2D3 and 47D5 does not significantly alter the binding characteristics of these Nanobodies to HER2.

The binding of the biparatopic 2D3-35GS-47D5 to HER2 was compared to the binding of the monovalent building blocks 2D3 and 47D5. Hereto, approximately 90 RU of the respective Nanobodies were immobilized and different concentrations (100-1000 nM) HER2-ECD was injected. As shown in Table C-4, the off-rate of the HER2-ECD from the 2D3-47D5 surface was 25× lower than the off-rate on each of the 2D3 and 47D5 surfaces, indicating an avidity effect caused by binding of HER2-ECD on both the 2D3 and 47D5 Nanobodies simultaneously (FIG. 19).

18.2 Biparatopic Nanobodies Combining Herceptin®- and Omnitarg Competitive Nanobodies Inhibit Heregulin-Mediated HER2-HER3 Signaling After ligand-binding, the HER receptors become activated by receptor dimerization between either two identical receptors (homodimerization) or different receptors of the same family (heterodimerization). After receptor dimerization, activation of the intrinsic protein kinase activity and tyrosine autophosphorylation occurs, recruiting and phosphorylating several intracellular substrates involving the Ras-Raf-MAPK, the PI3K/Akt, and other signaling pathways that regulate multiple biological processes including apoptosis and cellular proliferation. The mitogen-activated protein kinases (Erk1/Erk2) are one of the key endpoints in signal transduction pathways that ultimately trigger cancer cells to divide.

The ability of the biparatopic Nanobodies combining Herceptin® and Omnitarg-competitive Nanobodies to inhibit heregulin (HRG) activation of MAPK-Erk1/Erk2 was assessed in the following way. MCF7 cells ($5 \times 10^4$/well) were plated in serum-containing media in 24-well culture plates. The next day, media were removed and fresh media containing 0.1 serum were added to each well. The next day, prior to the assay, the media were replaced with serum-free medium. Cells were then incubated for 30 min with 50 nM of biparatopic Nanobody 2D3-35GS-47D5, 47D5-35GS-2D3, 5F7-35GS-47D5 or 47D5-35GS-5F7, monovalent 2D3, 5F7 or 47D5, Omnitarg-Fab or Herceptin®. Cells were then treated with 0.2 nM HRG for 15 min. The reaction was stopped by aspirating the cell medium. Cells were lysed by addition of lysis buffer (20 mM NP40, 20 mM Tris-HCl pH8, 10% glycerol, 2 mM EDTA, 1 mM sodium orthovanadate, complete protease inhibitor cocktail, 1% PBS). Protein concentration in the lysates was measured using BCA protein assay kit (Pierce) according to the manufacturer's indications. Equal amounts of protein were run on 10% polyacrylamide gels and electroblotted onto Invitrolon PVDF membranes (Invitrogen, Paisley, UK). The presence of phosphorylated Erk1/Erk2 (p44/42 MAPK) was assessed by probing the blots with phosphor-p44/42 MAPK (Thr202/Tyr204) antibody (Cell Signaling, Danvers, Mass.) and total MAPK was detected using p44/42 MAP kinase (137F5) rabbit mAb (Cell Signaling). The blots were visualized using a chemiluminescent substrate (Perkin Elmer, Wellesley, Mass., USA).

As shown in FIG. 20, biparatopic Nanobodies 2D3-35GS-47D5 and 5F7-35GS-47D5 significantly block HRG-mediated activation of MAPK to a greater extent than Omnitarg-Fab and Herceptin®, Surprisingly, when the Omnitarg-competing Nanobody 47D5 comprised the N-terminal Nanobody in the biparatopic constructs, i.e. 47D5-35GS-2D3 and 47D5-35GS-5F7, no significant reduction in MAPK activation could be observed. Monovalent Nanobodies 2D3, 5F7 and 47D5 could not block HRG-mediated MAPK activation in MCF-7 cells.

These data suggest that the position of the Nanobodies within the biparatopic Nanobody greatly influences the potency of the molecule. In addition, the length of the linker used to genetically fuse 2 Nanobodies biparatopic may be critically important to provide maximal flexibility between the 2 Nanobodies to allow tight binding to their respective binding epitope on HER2.

Biparatopic Nanobodies 2D3-35GS-47D5 and 5F7-35GS-47D5 were also shown to inhibit heregulin (HRG)-dependent Akt activation (FIG. 21). Activation of the PI3K signal transduction pathway is important for cell survival. Complexes formed between HER2 and either HER3 or EGFR can initiate these pathways in response to HRG. Incubation of MCF7 breast cancer cells with biparatopic Nanobodies 2D3-35GS-47D5 or 5F7-35GS-47D5 inhibited HRG-mediated. Akt activation to a greater extent than Omnitarg-Fab or Herceptin®. These data suggest that the biparatopic Nanobodies 2D3-35GS-47D5 or 5F7-35GS-47D5 may inhibit HER2 ligand-activation of P13 kinase and that this inhibition may lead to apoptosis.

Example 19

In-Silico Design of Optimal Linker Lengths in Biparatopic Nanobody Formats

In-silico design of optimal linker lengths for a biparatopic Nanobody format may for example be performed as follows. The 3-dimensional (3D) coordinates of the binding mode of each individual Nanobody to its respective epitope on the target are determined, for example from:
  a. a structure of the Nanobody-target complex determined by X-ray experiments or NMR experiments.
  b. a docking model of each Nanobody binding on their respective epitope on the target. Also a number of potential binding modes of each Nanobody to the target derived from docking studies can be used. Docking can be done by e.g. ZDock (Chen and Weng 2002, Proteins 47(3): 281-294; Chen and Weng 2003, Proteins 51(3): 397-408; Chen et al. 2003, Proteins 52(1): 80-87) and refined by RDock (Li et al. 2003, Proteins 53(3): 693-707) or by other methods (Fernandez-Recio et al. 2003, Proteins 52(1): 113-117).
  c. Binding mode of each Nanobody can be extracted from the same structure or from separate complexes. In the latter case, the binding modes of each Nanobody on a different epitope on the same target can be deduced by structural superposition of the different complexes.

A linker with a given sequence and thus of given length can be modelled between the 2 Nanobodies in different ways:
  a. By homology modelling (Sali, and Blundell J. 1993, Mol. Biol. 234: 779-815)
    i. The sequence of a construct Nanobody1-linker-Nanobody2 or Nanobody2-linker-Nanobody1 is drawn and stored in a readable sequence format (e.g. Fasta)
    ii. The 3-dimensional coordinates of the biparatopic construct is built by homology modelling by using the 3-dimensional coordinates (from X-ray, NMR or docking experiments) of the individual binding modes of the Nanobodies as a template.
  b. By de-novo design. A linker between the 2 Nanobodies binding on a different epitope on the same target can be build by de-novo design (Hu, et al. 2007, Proc. Natl. Acad. Sci. USA 104(45): 17668-17673).
  c. Several conformations of the linker are sampled and the lowest state energy conformations (1 or more) can be considered.

As a non-limiting example, the above was performed for a biparatopic construct comprising two Nanobodies. The modelling is shown in FIGS. 22A and 22B, which show a model of Nanobody 2D3 linked to another Nanobody docked on HER-2. Both figures show that we can dock a Nanobody to a target and predict its binding mode to the target. When doing this for several Nanobodies binding on non-overlapping epitopes on the same target, we can design a linker between the Nanobodies to create a multivalent Nanobody construct.

The 3-dimensional coordinates of the in-silico generated linker in the biparatopic construct are evaluated on at least one of the following criteria:
  a. Internal energy strain of the linker; possibly compared to a set of generated linkers of the same sequence in the free state. At least one but preferentially several energy terms are used (e.g. Van der Waals energy, electrostatics energy, dihedral angle deformation energy, etc.). To calculate the energy values an atom-based force-field (e.g. CHARMM (Brooks et al. 1983, J. Comp. Chem. 4: 187-217)) or other means of calculating potential energy (e.g. potentials of mean force (Muegge and Martin 1999, J. Med. Chem. 42: 791)) can be used.
  b. Internal energy strain on at least one of the residues (amino-acids) of the linker. For three biparatopic constructs 5F7-35GS-47D5, 47D5-35GS-5F7 and 47D5-40GS-5F7 energy penalty values were calculated for each residue in the linker as well as for 10 residues of each Nanobody connected to the linker. Energy values are shown in FIGS. 23, 24 and 25.
  c. The root-mean square deviation (RMSD) between the 3-dimensional coordinates of the 2 Nanobodies in the biparatopic construct and the 2 Nanobodies in their non-linked (monovalent) binding mode. The higher this value the less likely this linker is appropriate. FIG. 26 shows the backbone RMSD ($Å^2$) between the 5F7-linker-47D5 constructs (built by homology modelling) with the individual Nanobodies 5F7 and 47D5 in their unlinked binding mode. The linker length varies from 5 to 35. FIG. 26A shows that the RMSD-value is at a minimum value with linker lengths larger or equal to 15 residues. When shorter linkers are used (e.g. linker length=5, 10) we see an increased RMSD indicating that the Nanobodies in the bivalent construct are deviating from their monovalent binding mode. These in-silico experiments suggest that biparatopic constructs with linker lengths lower than 15 residues will have a significant deviation from the optimal binding mode of the individual Nanobodies to the target. In FIG. 26B a ribbon view is shown of the 5F7-linker-47D5 biparatopic construct for 2 linker lengths. The binding mode of the individual Nanobodies and the biparatopic constructs are shown. When a 35GS linker is used between the 2 Nanobodies and a very limited deviation from the individual binding modes is observed. However, when a 5GS linker is used, both Nanobodies in the biparatopic construct significantly deviate from their optimal binding mode.

d. Scores from scoring functions in homology modelling protocols which are derived based on a combination of experimental data and in-silico results (Sali & Overington, Protein Science 3(9):1582-1596, 1994).

As can be seen from the above results, the linker in this specific example should preferably be at least 15 amino acids in length, with linkers of between 20 and 40 amino acid residues, such as about 25, 30 or 35 amino acid residues, being particularly suited.

Also, constructs with different potentially suitable linker lengths (as determined by the above in silico analysis) may be prepared and tested for affinity/avidity, specificity, or potency using suitable binding assays or in vitro or in vivo potency assays, for example those mentioned in the present specification. In this way, optimal linker length may be determined, confirmed or verified.

Example 20

Construction of Multiparatopic Nanobodies for Broader Biological Activity

Simultaneous binding of 2 adjacent, non-overlapping epitopes by both arms of a biparatopic Nanobody without significant loss of entropy endows biparatopic Nanobodies with increased binding affinity to the target and as a result, higher potency can be obtained. The engineering of Nanobody fragments to obtain an increased potency or broader activity is not limited to the construction of biparatopic Nanobody fragments. Engineering of triparatopic and even tetratopic Nanobodies with careful selection of the epitopes targeted on the antigen, combined with rational design of linkers to allow maximal flexibility of the binding domains within the multiparatopic antibody, may for example result in the blocking of several critical interaction sites of the target, leading to improved potency and even an unparalleled biological activity.

TABLES

TABLE B-1

Preferred Nanobodies against HER2 obtained as described in Example 3

```
<Name, SEQ ID #; PRT (protein); ->

<13D11, SEQ ID NO: 2051; PRT; ->
EVQLVESGGGLVHPGGSLRLSCVGSGFSLDDYGMTW
VRRAPGKGLEWVSSINWSGTHTDYADSVKGRFTISRDNAKNTLFLQMNSLNPEDTAVYYCGQGWKIVPTNPRGHGTQVTVSS

<2B4, SEQ ID NO: 2052; PRT; ->
EVQLVESGGGLVQPGGSLRLSCVGSGFSLDDYAMTW
VRQAPGKGLEWVSSINWSGTHTDYADSVKGRFTISRDNAKNTLFLQMNSLSPEDTAVYYCNQGWKIRPTIPMGHGTQVTVSS

<2G2, SEQ ID NO: 2053; PRT; ->
EVQLVESGGGLVQPGGSLRLSCVASGFSLDDYGMTW
VRQAPGKGLEWVSSINWSGTHTDYTDPVKGRFTISRDNAKNTLFLQMNNLTPEDTAVYYCNRGWKIVPTDLGGHGTQVTVSS

<13D2, SEQ ID NO: 2054; PRT; ->
EVQLVESGGGLVQPGGSLRLSCVASGFSLDDYGMTW
VRQAPGKGLEWVSSINWSGTHTDYADSVKGRFTISRDNAKNTLFLQMNNLRSEDTAVYSCNQGWKIVPTDRGGHGTQVTVSS

<2D5, SEQ ID NO: 2055; PRT; ->
EVQLVESGGGLVQPGGSLRLSCVASGFSLDDYGMTW
VRQAPGKGLEWVSSINWSGTHTDYADSVKGRFTISRDNAKNTLFLQMNSLRSEDTAVYYCNQGWKIVPTDRGGHGTQVTVSS

<2F4, SEQ ID NO: 2056; PRT; ->
EVQLVESGGGLVQPGGSLRLSCVASGFSLDDYGMTW
VRQAPGKGLEWVSSINWSGTHTDYADSVKGRFTISRDNAKNTLFLQMNSLRSEDTAVYYCNQGWKIVPTDRRGHGTQVTVSS

<2C3, SEQ ID NO: 2057; PRT; ->
EVQLVESGGGLVQPGGSLRLSCVASGFSLDDYGMTW
VRQAPGKGLEWVSSINWSGTHTDYADSVKGRFTISRDNAKNTLFLQMNSLRSEDTAVYYCNQGWKIVPTDRTGHGTQVTVSS

<17E3, SEQ ID NO: 2058; PRT; ->
EVQLVESGGGLVQAGGSLRLSCVASKMTFMRYTMGW
YRQAPGKQRDLVASIDSSGGTNYADSVKGRFTISRDNAKNTVYLEMNSLTPEDTAVYYCNQGWKIVPTDRTGHGTQVTVSS

<17H3, SEQ ID NO: 2059; PRT; ->
EVQLMESGGGLVQPGGSLRLSCVASGFSLDDYGMTW
VRQAPGKGLEWVSSINWSGTHTDYADSVKGRFTISRDNAKNTLFLQMNSLRSEDTAVYYCNQGWKIVPTDRGGHGTQVTVSS

<17D2, SEQ ID NO: 2060; PRT; ->
EVQLVESGGGLVQPGGSLRLSCVASGFSLDDYGMTW
VRQAPGKGLEWVSSINWSGTHTDYADSVKGRFTISRDNAKNTLFLQMNSLRSEDTAVYYCNQGWKIVPTDRGSHGTQVTVSS

<2F1, SEQ ID NO: 2061; PRT; ->
EVQLVESGGGLVQPGGSLRLSCVASGFSLDDYGMTW
VRQAPGKELEWISSINWSGTHTDYADSVKGRFTISRDNAKNTLFLQMNSLTPEDTAVYYCNQGWKIVPMDRRGHGTQVTVSS
```

TABLE B-1-continued

Preferred Nanobodies against HER2 obtained as described in Example 3

<Name, SEQ ID #; PRT (protein); ->

<2E2, SEQ ID NO: 2062; PRT; ->
EVQLVESGGGLVQPGGSLRLSCVASGFSLDDYGMTW
VRQAPGKGLEWVSSINWSGTHTDYADSVKGRFTISRDNAKNTLFLQMNSLTPEDTAVYYCNQGWKIIPTDRRGHGTQVTVSS

<2C2, SEQ ID NO: 2063; PRT; ->
EVQLVESGGGLVQGGSLRLSCVASGFSLDDYAMTW
VRQAPGKGLEWVSSINWSGTHTDYADSVKGRFTISRDNARNTLFLQMNSLTPEDTAIYYCNQGWKILPTDRRGHGTQVTVSS

<2E3, SEQ ID NO: 2064; PRT; ->
EVQLVESGGGLVQPGGSLRLSCVASGFSLDDYGMTW
VRQAPGKGLEWVSSINWSGTHTDYADSVKGRFTISRDNAKNTLFLQMNSLSPEDTAVYYCNQGWKILPTNRGSHGTQVTVSS

<13B10, SEQ ID NO: 2065; PRT; ->
EVQLVESGGGLVQPGGSLRLSCVASGFSLDDYGMTW
VRQAPGKGFEWVSSINWSGTHTDYADSVKGRFTISRDNAKNTLFLQMNSLSPEDTAVYYCNQGWKILPTNRGSHGTQVTVSS

<2D1, SEQ ID NO: 2066; PRT; ->
EVQLVESGGGLVQPGGSLRLSCVASGFSLDDYGMTW
VRQAPGKGLEWVSSINWSGTHTDYADSVKGRFTISRDNAKNTLFLQMNSLSPEDTAVYYCNRGWKILPTNRGSHGTQVTVSS

<2H3, SEQ ID NO: 2067; PRT; ->
EVQLVESGGGLVQPGGSLRLSCVASGFSLDDYGMTW
VRQAPGKGLEWVSSINWSGTHTDYADSVKGRFTISRDNAKNTLFLQMNSLTPEDTAVYYCNQGWKIIPTDRRGHGTQVTVSS

<2H1, SEQ ID NO: 2068; PRT; ->
EVQLVESGGGLVQPGGSLRLSCVASGFSLDDYGMTW
VRQAPGKGLEWVSSINWSGTHTDYADSVRGRFVISRDNAKNTLFLQMNSLSPEDTAVYYCNQGWKIIPTDRRGHGTQVTVSS

<2C1, SEQ ID NO: 2069; PRT; ->
EVQLVESGGGLVQPGGSLRLSCVASGFSLDDYGMTW
VRQAPGKGLEWVSSINWSGTHTDYTDSVKGRFTISRDNAKNTLFLQMNSLTPEDTAVYYCNQGWKIIPTDRRGHGTQVTVSS

<15C5, SEQ ID NO: 2070; PRT; ->
EVQLVESGGGLVQPGGSLKLSCVASGFSLDDYGMTW
VRQAPGKGLEWVSSINWNVTHTDYAYSVKGRFTISRDNAKNTLFLQMNSLTPEDTAVYYCNQGWKIIPTDRRGHGTQVTVSS

<2B3, SEQ ID NO: 2071; PRT; ->
EVQLVESGGGLVQPGGSLRLSCVASGFSLDDYGMTW
VRQAPGKGLEWVSSINWSGTHTDCADSVKGRFTISRDNAKNTLFLQMNSLTPEDTAVYYCNQGWKIIPTDRRGHGTQVTVSS

<29H2, SEQ ID NO: 2072; PRT; ->
EVQLVESGGGLVQGGSLRLSCVASGFSLDDYGMTW
VRQAPGKGLEWVSSINWSGTHTDYADSVKGRFTISRDNAKNTLFLQMNNLTPEDTAVYYCNQGWKIIPTDRRGHGTQVTVSS

<17E4, SEQ ID NO: 2073; PRT; ->
EVQLVESGGGLVQPGGSLRLSCVASGFSLDDYGMTW
VRQAPGKGLEWVSSINWSGTHTDYADSVKGRFVISRDNAKNTLFLQMNSLSPEDTAVYYCNQGWKIIPTDRRGHGTQVTVSS

<17A2, SEQ ID NO: 2074; PRT; ->
EVQLVESGGGLVQPGGSLRLSCVASGFSLDDYAMTW
VRQAPGKGLEWVSSINWSGTHTDYADSVKGRFTISRDNAKNTLFLQMNSLSPEDTAVYYCNKGWKVWPTDRGTHGTQVTVSS

<15D1, SEQ ID NO: 2075; PRT; ->
EVQLVESGGGLVQPGGSLRLSCVASGFSLDDYAMTW
VRQAPGKGLEWVSSINWSGTHTDYADSVKGRFTISRDNAKNTLFLQMNSLNPEDTAVYYCNQGWKVWPTDRGTHGTQVTVSS

<17B8, SEQ ID NO: 2076; PRT; ->
EVQLVESGGGLVQPGGSLRLSCVASGFSLDDYGMTW
VRQAPGKGLEWVSSINWSGTHTDYADSVKGRFTISRDNAKNTLFLQMNSLTPEDTAVYYCNQGWKILPAERRGHGTQVTVSS

<15C11, SEQ ID NO: 2077; PRT; ->
EVQLVESGGGLVQPGGSLRLSCVASGFSLDDYGMTW
VRQAPGKGLEWVSSINWSGTHTDYADSVKGRFTISRDNAKNTLFLQMNSLTPEDTAVYYCNQGWKILPAERRGHGTPVTVSS

<15G8, SEQ ID NO: 2078; PRT; ->
EVQLVESGGGLVQPGGSLKLSCVASGFSLDDYGMTW
VRQAPGKGLEWVSSINWNGTHTDYAYSVKGRFTISRDNAKNTLFLQMNSLTPENTAVYYCNQGWKILPAERRGHGTVTVSS

<17H4, SEQ ID NO: 2079; PRT; ->
EVQLVESGGGLVQPGGSLRLSCVASGFSLINYAMTW
VRQAPGKGLEWVSSINWSGTHTDYADSVKGRFTISRDNAKNTLFLHMNNLSPEDTAVYYCGQGWKIHPADRGGHGTQVTVSS

<27G8, SEQ ID NO: 2080; PRT; ->
EVQLVESGGGLVQPGGSLRLSCVASGFSLDDYGMTW
VRQAPGKGLEWVSSINWSGTHTDYADSVKGRFTISRDNAKNTLFLQMNSLTPEDTAVYYCNQGWKILPAERRGHGTQVTVSS

TABLE B-1-continued

Preferred Nanobodies against HER2 obtained as described in Example 3

<Name, SEQ ID #; PRT (protein); ->

<38C6, SEQ ID NO: 2081; PRT; ->
EVQLVESGGGLVQPGGSLRLSCVGSGFSLDDYAMTW
VRQAPGKGLEWVSSINWSGTHTDYADSVKGRFTISRDNAKNTLFLQMNSLSPEDTAVYYCNQWKIRPTIPMGHGTQVTVSS

<2A4, SEQ ID NO: 2082; PRT; ->
EVQLVESGGGLVQPGGSLRLSCAASGFIFDDYAMSW
VRQAPGKGLEWVSAINWSGSHRNYADSVKGRFTISRDNAKKTVYLQMNSLQSEDTAVYYCGTWQSTTKNQGYWGQGTQVTVSS

<15G7, SEQ ID NO: 2083; PRT; ->
EVQLVESGGGLVQPGGSLRLSCAASGFIFDDYAMSW
VRQAPGKGLEWVSAINWSGTHRNYADSVKGRFTISRDNNKKTVYLQMNSLKSEDTAVYYCATWQSTTKNQGYWGQGTQVTVSS

<15B7, SEQ ID NO: 2084; PRT; ->
EVQLVESGGGLVQPGGSLKLSCAASGFIFDDYAMSW
VRQAPGKGLEWVSAINWSGSHRNYADSVKGRFTISRDNAKKTVYLQMNSLQSEDTAVYYCGTWQSTTKSQGYWGQGTQVTVSS

<5G4, SEQ ID NO: 2085; PRT; ->
EVQLVESGGGLVQPGGSLTLSCAGSGFIFDDYAMSW
VRQAPGKGLEWVSSINWSGSHRNYADSVKGRFTISRDNAKKTLYLQMNSLKSEDTAVYYCATWQSTTKNQNYWGQGTQVTVSS

<13B2, SEQ ID NO: 2086; PRT; ->
EVQLVESGGSLVQPGGSLRLSCAASGFTFDDYAMSWVRQAPGKGLEW
ISSINWSGTHKDYADSVKGRFTISRNNANNTLYLQMNNLKFEDTAVYYCAKNWRDAGTTWFEKSGSAGQGTQVTVSS

<2E5, SEQ ID NO: 2087; PRT; ->
EVQLVESGGSLVQPGESLRLSCAASGFTFDDYAMSWVRQAPGKGLEW
ISSINWSGTHTDYADSVKGRFTISRNNANNTLYLQMNNLKFEDTAVYYCAKNWRDAGTTWFEKSGSAGQGTQVTVSS

<15G1, SEQ ID NO: 2088; PRT; ->
EVQLVESGGSLVPPGGSLRLSCAASGFTFDDYAMSWVRQAPGKGLEW
VSSINWSGTHTDYTDSVKGRFTISRNNANNTLYLQMNSLKSEDTAVYYCAKNWRDAGTTWFEKSGSAGQGTQVTVSS

<27B1, SEQ ID NO: 2089; PRT; ->
EVQLVESGGSLVQPGGSLRLSCAASGFTFDDYAMSWVRQAPGKGLEW
ISSINWSGTHTDYADSVKGRFTISRNNANNTLYLQMNNLKFEDTAVYYCAKNWRDAGTTWFEKSGSAGQGTQVTVSS

<17E7, SEQ ID NO: 2090; PRT; ->
EVQLVESGGSLVQPGGSLRLSCAASGFTFDDYAMSWVRQVPGKGLEW
VSSINWSGTHTDYADSVKGRFTISRNNANNTLYLQMNSLKSEDTAVYYCAKNWRDAGTTWFEKSGSAGQGTQVTVSS

<17D8, SEQ ID NO: 2091; PRT; ->
EVQLVESGGSLVPPGGSLRLSCAVSGFTFDDYAMSWVRQAPGKGLEW
VSSINWSGTHTDYTDSVKGRFTISRNNANNMLYLQMNSLKSEDTAVYYCAKNWRDAGTTWFEKSGSAGQGTQVTVSS

<5F8, SEQ ID NO: 2092; PRT; ->
EVQLVESGGSLVQPGGSLRLSCAASGFTFDDYALSWVRQAPGKGLEW
ISSINWSGTHTDYADSVKGRFTISRNNANNTLYLQMNNLKFEDTAVYYCAKNWRDAGTTWFEKSGSAGQGTQVTVSS

<2D4, SEQ ID NO: 2093; PRT; ->
EVQLVESGGSLVQPGGSLRLSCAASGFTFDDYAMTWVRQAPGKGLEW
VSSINWSGTHTDYADSVKGRFTISRNNANNTLYLQMNSLKSDDTAVYYCAKNWGDAGTTWFEKSGSAGPGTQVTVSS

<13D8, SEQ ID NO: 2094; PRT; ->
EVQLVESGGSLVQPGGSLRLSCAASGFTFDDYAMTWVRQASGKGLEW
VSSINWSGTHTDYTDSVKGRFTISRNNANNTLYLQMNSLKSEDTAVYYCAKNWGDAGTTWFEKSGSAGQGTQVTVSS

<17G8, SEQ ID NO: 2095; PRT; ->
EVQLVESGGSLVPPGGSLRLSCAASGFTFDDYAMSWVRQAPGKGLEW
VSSINWSGTHTGYTDSVKGRFTISRNNANNTLYLQMNSLKSEDTAVYYCAKNWGDAGTTWFEKSGSAGQGTQVTVSS

<2H4, SEQ ID NO: 2096; PRT; ->
EVQLVESGGSLVQPGGSLRLSCAASGFTFDDYAMTWVRQAPGKGLEW
VSSINWSGTHTDYTDSVKGRFTISRNNANNTLYLQMNSLKSEDTAVYYCAKNWGDAGTTWFEKSGSAGQGTQVTVSS

<2F3, SEQ ID NO: 2097; PRT; ->
EVQLVESGGSLVQPGGSLRLSCAASGFTFDDYAMTWVRQAPGKGLEW
VSSINWSGTHTDYTGSVKGRFTISRNNANNTLYLQMNSLKSDDTAVYYCAKNWGDAGTTWFEKSGSAGPGTQVTVSS

<2F5, SEQ ID NO: 2098; PRT; ->
EVQLVESGGSLVPPGGSLRLSCAASGFTFDDYAMSWVRQAPGKGLEW
VSSINWSGTHTDYTDSVKGRFTISRNNANNTLYLQMNSLKSEDTAVYYCAKNWGDAGTTWFEKSGSAGQGTQVTVSS

<30E10, SEQ ID NO: 2099; PRT; ->
KVQLVESGGSLVPPGGSLRLSCAASGFTFDDYAMTWVRQAPGKGLEW
VSSINWSGTHTDYTDSVKGRFTISRNNANNTLYLQMNSLKSEDTAVYYCAKNWGDAGTTWFEKSGSAGQGTQVTVSS

TABLE B-1-continued

Preferred Nanobodies against HER2 obtained as described in Example 3

<Name, SEQ ID #; PRT (protein); ->

<29H1, SEQ ID NO: 2100; PRT; ->
EVQLVESGGSLVPPGGSLRLSCAASGFTFDDYAMSWVRQAPGKGLEW
VSSINWSGTHTGYTDSVKGRFTISRNNANNTLYLQMNSLKSEDTAVYYCAKNWGDAGTTWFEKSGSAGQGTQVTVSS

<17E2, SEQ ID NO: 2101; PRT; ->
EVQLVESGGSLVPPGGSLRLSCAASGFTFDDYGMSWVRQAPGKGLEW
VSSINWSGTHTDYTDSVKGRFTISRNNANNTLYLQMNSLKSEDTAVYYCAKNWGDAGTTWFEKSGSAGQGTQVTVSS

<2B1, SEQ ID NO: 2102; PRT; ->
EVQLVESGGSLVQPGGSLRLSCAASGFTFDDYAMTWVRQAPGKGLEW
VSSINWSGTHTDYTDSVKGRFTISRNNANNTLYLQMNSLKSDDTAVYYCAKNWGDAGTTWFEKSGSAGPGTQVTVSS

<2A5, SEQ ID NO: 2103; PRT; ->
EVQLVESGGGLVQPGGSLRLSCATSGFTFDDYAMTWVRQAPGKGLEW
VSSINWSGTHTDYTDSVKGRFTISRNNANNTLYLQMNSLKSEDTAVYYCAKNWGDAGTTWFEKSGSAGQGTQVTVSS

<13C12, SEQ ID NO: 2104; PRT; ->
EVQLVESGGSLVQPGGSLRLSCATSGFTFDDYAMTWVRQAPGKGLEW
VSSINWSGTHTDYTDSVKGRFTISRNNANNTLYLQMNSLKSEDTAVYYCAKNWGDAGTTWFEKSGSAGQGTQTVSS

<17E10, SEQ ID NO: 2105; PRT; ->
EVQLVESGGSLVQPGGSLRLSCAASGFTFDDYAMTWVRQAPGKGLEW
VSSINWSGTHTDCTDSVKGRFTISRNNANNTLYLQMNSLKSEDTAVYYCAKNWGDAGTTWFEKSGSAGQGTQVTVSS

<27D4, SEQ ID NO: 2106; PRT; ->
EVQLVESGGSLVQPGGSLRLSCAASGFTFDDYAMTWVRQASGKGLEW
VSSINWSGTHTDYADSVKGRFTISRNNANNTLYLQMNSLKSEDTAVYYCAKNWGDAGTTWFEKSGSAGQGTQVTVSS

<15F9, SEQ ID NO: 2107; PRT; ->
EVQLVESGGSLVQPGGSLRLSCAASGFTFDDYAMTWVRQAPGKGLEW
VSSINWSGTHTDYTGSVKGRFTISRNNANNTLYLQMNSLKSDDTAVYYCAKNWGDAGTTWFEKSGSAGQGTQVTVSS

<30H9, SEQ ID NO: 2108; PRT; ->
EVQLVESGGSLVQPGGSLRLSCAASGFTFDDYAMTWVRQAPGKGLEW
VSSINWSGTHTDYTDSVKGRFTISRNNANNTLYLQMNSLKSEDTAVYYCAKNWGDAGTTWFEKSGSAGQGTQVTVSS

<39C1, SEQ ID NO: 2109; PRT; ->
EVQLVESGGSLVPPGGSLRLSCAASGFTFDDYGMSWVRQAPGKGLEW
VSSINWSGTHTDYTDSVKGRFTISRNNANNTLYLQMNSLKSEDTAVYYCAKNWGDAGTTWFEKSGSAGQGTQVTVSS

<27G2, SEQ ID NO: 2110; PRT; ->
EVQLVESGGSLVQPGGSLRLSCAASGFTFDDYAMTWVRQTPGKGLEW
VSSINWSGTHTDYTDSVKGRFTISRNNANNTLYLQMNSLKSDDTAVYYCAKNWGDAGTTWFEKSGSAGPGTQVTVSS

<2D3, SEQ ID NO: 2111; PRT; ->
EVQLVESGGSLVQPGGSLRLSCAASGFTFDDYAMSWVRQVPGKGLEW
VSSINWSGTHTDYADSVKGRFTISRNNANNTLYLQMNSLKSEDTAVYYCAKNWRDAGTTWFEKSGSAGQGTQVTVSS

<5F7, SEQ ID NO: 2112; PRT; ->
EVQLVESGGGLVQAGGSLRLSCAASGITFSINTMGWYRQAPGKQREL
VALISSIGDTYYADSVKGRFTISRDNAKNTVYLQMNSLKPEDTAVYYCKRFRTAAQGTDYWGQGTQVTVSS

<47D5, SEQ ID NO: 2114; PRT; ->
KVQLVESGGGLVQPGGSLRLSCAASGSIFGFNDMAWYRQAPGKQREL
VALISRVGVTSSADSVKGRFTISRVNAKDTVYLQMNSLKPEDTAVYYCMDQRLDGSTLAYWGQGTQVTVSS

<14B11, SEQ ID NO: 2115; PRT; ->
EVQLVESGGGLVQAGGSLRLSCAASGSTFSSYGMGWFRQVPGKEREF
VATINWSGVTAYADSVKGRFTISRDNAKKTVYLQMNSLKPEDTARYYCGVETYGSGSSLMTEYDYWGQGTQVTVSS

<14B10, SEQ ID NO: 2116; PRT; ->
EVQLVESGGGLVQAGGSLRLSCAVNSRTFSSYGMGWFRQAPGKEREF
VATINWSGVTAYADSIKGRFTISRDNAKETVYLQMNSLKPDDTGVYYCAAETYGSGSSLMSEYDYWGQGTQVTVSS

<14B4, SEQ ID NO: 2117; PRT; ->
EVQLVESGGGLVQAGGSLRLSCAVSSRAFSSYGMGWFRQAPGKDREF
VATINWSGVTAYADSIKGRFTISRDNAKETVYLQMNSLKPEDTGVYYCAAETYGSGSSLMSEYDYWGQGTQVTVSS

<14C11, SEQ ID NO: 2118; PRT; ->
EVQLVESGGGLVQAGGSLRLSCAVNSRTFSSYGMGWFRQAPGKEREF
VATINWSGATAYADSIKGRFTISRDNAKETVYLQMNSLKPDDTGVYYCAAETYGSGSSLMSEYDYWGQGTQVTVSS

<14B5, SEQ ID NO: 2119; PRT; ->
EVQLVESGGGLVQAGGSLRLSCAVSSRAFSSYGMGWFRQAPGKDREF
VATINWSGVTAYADSIKGRFTISRDNAKETVYLQMNSLKPDDTGVYYCAAETFGSGSSLMSEYDYWGQGTQVTVSS

TABLE B-1-continued

Preferred Nanobodies against HER2 obtained as described in Example 3

<Name, SEQ ID #; PRT (protein); ->

<14C6, SEQ ID NO: 2120; PRT; ->
EVQLVESGGGSVQAGGSLRLSCVASEGTFSSYGMGWFRQAPGKERAF
VATINWSGVTAYADSVKGRFTISRDNAKKTVYLQMNSLKPEDTAVYYCATDTYGSGSSLMNEYDYWGQGTQVTVSS

<14A4, SEQ ID NO: 2121; PRT; ->
EVQLVESGGGSVQAGSSLTLSCVASEGTFSSYGMGWFRQAPGKERAF
VATINWSGVNAYADSVKGRFTISRDNAKKTAYLQMNSLKPEDTAVYYCAAETYGSGSSLMNEYDYWGQGTQVTVSS

<14B3, SEQ ID NO: 2122; PRT; ->
EVQLVESGGGLVQPGGSLTLSCVASEGTFSSYGMGWFRQAPGKERAF
VATINWSGVNAYADSVKGRFTISRDNAKKTAYLQMNSLKPEDTAVYYCAAETYGSGSSLMNEYDYWGQGTQVTVSS

<14C1, SEQ ID NO: 2123; PRT; ->
EVQLVESGGGSVQAGGSLRLSCAASGSTFSSYGMGWFRQAPGKERAF
VATINWSGVTAYADSVKGRFTISRDNAKKTVYLQMNSLKPEDTAVYYCATETYGSGSSLMNEYDYWGQGTQVTVSS

<14A12, SEQ ID NO: 2124; PRT; ->
EVQLVKSGGGLVQAGGSLRLSCAASERTFSSYGMGWFRQAPGKEREF
VATINWSGVTAYADSVKGRFTISRDNAKKTVYLQMNSLKPEDTAVYYCAAEPYGSGSSLISEYDYWGHGTQVTVSS

<14A2, SEQ ID NO: 2125; PRT; ->
EVQLVESGGGLVQAGGSLRLSCAASERTFSSYGMGWFRQAPGKEREF
VATINWSGVTAYADSVKGRFTISRDNAKKTVYLQMNSLKPEDTAVYYCAAEPYGSGSSLISEYDYWGHGTQVTVSS

<14A1, SEQ ID NO: 2126; PRT; ->
EVQLVESGGGSVQAGGSLRLSCAASERTFSSYGMGWFRQAPGKEREF
VATINWSGVTAYADSVKGRFTISRDNAKKTVYLQMNSLKPEDTAVYYCAAEPYGSGSSLMSEYDYWGHGTQVTVSS

<17C3, SEQ ID NO: 2127; PRT; ->
EVQLVESGGGLVQAGGSLRLSCAANGLTFRRYDMGWYRQAPGQQREW
VAAISGAGDINYADSVKGRFTMARDNANHTVHLQMNSLKPEDTAVYYCNANWKMLLGVENDYWGQGTQVTVSS

<46D3, SEQ ID NO: 2128; PRT; ->
KVQLVESGGGLVQAGGSLRLSCAASGRTFTEYSMGWFRQAPGKEREF
VATISWNYGYTYYSDSVKGRFTVSRDIAENTVYLQMNTLKSEDTAVYYCAAKIGWLSIRGDEYEYWGQGTQVTVSS

<27H5, SEQ ID NO: 2129; PRT; ->
EVQLVESGGGLVQAGGSLRLSCAASGFTFDDYGIGWFRQASGKEREG
VSCITSSDGSTYYADSVKGRFTISSDNAKNTVYLQMNSLKPEDTAVYYCAALPFVCPSGSYSDYGDEYDYWGQGTQVTVSS

<17C2, SEQ ID NO: 2130; PRT; ->
EVQLVESGGGLVQPGGSLRLSCAASGFAFSSYAMSWVRQAPGKGLEW
VSAVDSGGGRTDYAHSVKGRFTISRDNAKNTLYLQMSSLKPEDTALYYCTKHVSDSDYTEYDYWGQGTQVTVSS

<17D11, SEQ ID NO: 2131; PRT; ->
EVQLVESGGGLVQAGGSLRLSCTASGRTSSTSAMGWFRQAPGKEREF
VATISRGGSATYYADSLKGRFTISRDNAKNTLYLQMNSLKPEDTAVYYCAARRSSLYTSSNVFEYDYWGQGTQVTVSS

<15A6, SEQ ID NO: 2132; PRT; ->
EVQLVESGGGLVQAGGSLRLSCVTSRRPASTRTMAWYRQAPGKQRDW
VATISSHGLPVYADSVKGRFTVSRDNANNTVYLQMNTLKPEDTAVYYCRDVNADYWGQGTQVTVSS

<17B6, SEQ ID NO: 2133; PRT; ->
EVQLVESGGGLVQPGGSLRLSCAASRIPFSTRTMAWYRQAPGKQRDW
VATIGTSGPPRYADSVKGRFTVSRDNAKNTVYLQMNSLKAEDTAVYYCWDVNADYWGQGTQVTVSS

<17C5, SEQ ID NO: 2134; PRT; ->
EVQLVESGGGLVQAGGSLRLSCVTSRRPASTRTMAWYRQAPGKQRDW
VATISSHGLPVYADSVKGRFTVSRDNANNTVYLQMNTLKPEDTAVYYCRDVNADYWGQGTPVTVSS

<15E11, SEQ ID NO: 2135; PRT; ->
EVQLVESGGGLVQAGGSLRLSCVASRIPFSSRTMAWYRQAPGKQRDW
VATISARGMPAYEDSVKGRFTVSRDNDKNTLYLQMNSLKPEDTAVYYCRDVNADYWGQGTQVTVSS

<15C2, SEQ ID NO: 2136; PRT; ->
EVQLVESGGGLVQAGGSLRLSCVTSRRPASTRTMAWYRQAQGKQRDW
VATISSHGLPVYADSVKGRFTVSRDNANNTVYLQMNTLKPEDTAVYYCRDVNADYWGQGTQVTVSS

<2A3, SEQ ID NO: 2137; PRT; ->
EVQLVESGGGLVQAGGSLNLSCVASGIPFSTRTMAWYRQAPGKPRDW
VATIRNGAPVYADSVKGRFTVSRDNAKNTLYLQMNSLKPEDTATYLCRDVNGDIWGQGTQVTVSS

<27A5, SEQ ID NO: 2138; PRT; ->
EVQLVESGGGLVQAGGSLNLSCVASGIPFSTRTMAWYRQPPGNERDW
VATIRSGAPVYADSVKGRFTVSRDNAKNTLYLQMNSLEPEDTATYYCWDVNGDIWGQGTPVTVSS

TABLE B-1-continued

Preferred Nanobodies against HER2 obtained as described in Example 3

<Name, SEQ ID #; PRT (protein); ->

<2C5, SEQ ID NO: 2139; PRT; ->
EVQLVESGGGLVQAGGSLNLSCVASGIPFSTRTMAWYRQTPGKSRDW
VATIRSGTPVYADSVKGRFTVSRDNAKNTLYLRMNSLKSEDSATYTCRAVNADIWGQGTQVTVSS

<27G5, SEQ ID NO: 2140; PRT; ->
EVQLVESGGGLVQPGGSLRLSCVASRIPASIRTMAWYRQTPGNQRDW
LATIGSSGTPAYADSVKGRFTVSRDNAKNTVYLQMNSLKPEDTAVYYCRDVNGDYWGQGTQVTVSS

<13A9, SEQ ID NO: 2141; PRT; ->
EVQLVESGGGLVQAGGSLRLSCVASRIPASIRTMAWYRQAPGKQRDW
VATIGTGGTPAYADSFKGRFTVSRDNANHTVYLQMNSLKPEDTAVYYCRDVNGDYWGQGTQVTVSS

<29E9, SEQ ID NO: 2142; PRT; ->
EVQLVESGGGLVQPGGSLRLSCVASRIPASIRTMAWYRQTPGNQRDW
LATIGSSGTPAYADSVKGRFTVSRDNAKNTVYLQMNSLKPEDTAVYYCRDVNGDYWGQGTQVTVSS

<15D8, SEQ ID NO: 2143; PRT; ->
EVQLVESGGGLVQPGGSLKLSCVASTIPASIRTMAWYRQTPGNQRDW
LATIGSSGTPAYADSVKGRFTVSRDNAKNTVYLQMNSLKPEDTAVYYCRDVNGDYWGQGTQVTVSS

<15G4, SEQ ID NO: 2144; PRT; ->
EVQLVESGGGLVQAGGSLRLSCVASGIPFRSRTMAWYRQAPGKTRDW
VATIGTHGTPLYADSVKGRFTVSRDNAKNTLYLQMNSLKPEDTAVYYCWDVNGDYWGQGTQVTVSS

<15D12, SEQ ID NO: 2145; PRT; ->
EVQLVESGGGLVQAGESLRLSCATSGITFKRYVMGWYRQGPGKQREL
VATVNDGGTTSYADSVKGRFAISRDNAKNTAYLQMNSLKAEDTAVYYCNAVWKLPRFVDNDYWGQGTQVTVSS

<15E12, SEQ ID NO: 2146; PRT; ->
EVQLMESGGGLVQAGGSLRLSCAANGLTFRRYDMGWYRQAPGQQREW
VAAISGAGDINYADSVKGRFTMARDNANHTVHLQMNSLKPEDTAVYYCNANWKMLLGVENDYWGQGTQVTVSS

<13D7, SEQ ID NO: 2147; PRT; ->
EVQLVESGGGLVQAGGSLRLSCAANGLTFRRYDMGWYRQAPGQQREW
VAAISGAGDINYADSVKGRFTMARDNANHTVHLQMNSLKPEDTAVYYCNANWKMLLGVENDYWGQGTQVTVSS

<13A8, SEQ ID NO: 2148; PRT; ->
EVQLVESGGGLVQPGGSLRLSCAASGLGIAFSRRTMAWYRQAPGKQR
DWVATIAGDGSTVYADSMKGRFTISRDNAENTVYLQMNSLKPEDTAVYYCWDVNRDYWGQGTQVTVSS

<15A4, SEQ ID NO: 2149; PRT; ->
EVQLVESGGGLVQPGGSLRLSCAASGLGIAFSRRTMAWYRQAPGKQR
DWVATIAGDGSTVYADSMKGRFTISRDNAKNTVYLQINSLKPEDTAVYYCWDVNRDYWGQGTQVTVSS

<17F7, SEQ ID NO: 2150; PRT; ->
EVQLVESGGGLVQAGGSLRLSCVASGIAQSIRVMAWYRQPPGKQRDW
VGTISSDGTANYADSVKGRFTISRDNAKKTMYLQMNSLKPDDTAVYYCRDVNRDYWGQGTQVTVSS

<15C8, SEQ ID NO: 2151; PRT; ->
EVQLVESGGGLVQAGGSLRLSCAASGIAFRIRTMAWYRQAPGKQRDW
VATSDSGGTTLYADSVKGRFTVSRDNAENTVYLQMNSLKPEDTAVYYCRDVNRDYWGQGTQVTVSS

<17A10, SEQ ID NO: 2152; PRT; ->
EVQLVESGGGLVQAGGSLRLSCVASGIPSIRAIAWYRQAPGKQRDW
VATSGTGYGATYDDSVKGRFTLSRDNAKNTVYLQMNSLKPEDTAVYYCRDVNRDYWGQGTQVTVSS

<27D3, SEQ ID NO: 2153; PRT; ->
EVQLMESGGGLVQPGGSLRLSCAASGLGIAFSRRTMAWYRQAPGKQRDW
VATIAGDGSTVYADSMKGRFTISRDNAENTVYLQMNSLKPEDTAVYYCWDVNRDYWGQGTQVTVSS

<13B12, SEQ ID NO: 2154; PRT; ->
EVQLVESGGGLVQAGGSLRLSCAASGIAFRIRTMAWYRQAPGKQRDW
VATIGSDGTTIYADSVKGRFTLSRHNAENTVYLQMNSLKPEDTAVYYCRDVNRDYWGQGTQVTVSS

<15B2, SEQ ID NO: 2155; PRT; ->
EVQLVESGGGLVQAGGSLRLSCVVSGIPSSIRAMAWYRQAPGRQRDW
VATIYSPSGSAVYADSVKGRFTISSDNAKSTIYLQMNSLKPDDTAVYYCRDVNRDYWGQGTQVTVSS

<15B11, SEQ ID NO: 2156; PRT; ->
EVQLVESGGGSVQAGGSLRLSCVVSGIPSSIRAMAWYRQAPGRQRDW
VATIYSRSGGAVYADSVKGRFTISSDNAKNTIYLQMNSLKPDDTAVYYCRDVNRDYWGQGTQVTVSS

<13C9, SEQ ID NO: 2157; PRT; ->
EVQLVESGGGLVQAGGSLRLSCVASGIPSIHAMAWYRQAPGKQRDW
GATTYSRGGTTYNDSAKGRFTISRDNAKKTVYLQMNSLKPEDTAVYYCRDVNRDYWGQGTQVTVSS

TABLE B-1-continued

Preferred Nanobodies against HER2 obtained as described in Example 3

<Name, SEQ ID #; PRT (protein); ->

<17D5, SEQ ID NO: 2158; PRT; ->
EVQLVESGGGLVQPGGSLRLSCAASGIIGTIRTMAWYRQAPGKQRDW
VASIGTRGAPVYADSVNGRFTISRDGATNTVFLQMNNLKPEDTAVYYCRDVNRDYWGQGTQVTVSS

<27B5, SEQ ID NO: 2159; PRT; ->
EVQLVESGGGLVQAGGSLRLPCAASGIAFRIRTMAWYRQAPGKQRDW
VATSDSGGTTLYADSVKGRFTVSRDNAENTVYLQMNSLKPEDTAVYYCRDVNRDYWGQGTQVTVSS

<27C7, SEQ ID NO: 2160; PRT; ->
EVQLVESGGGLVQAGGSLRLSCAASGIAFRIRTMAWYRQAPGKQRDW
VATSDSGGTTLYADSVKGRFTVSRDNADNTVYLQMNSLKPEDTAVYYCRDVNRDYWGQGTQVTVSS

<13D4, SEQ ID NO: 2161; PRT; ->
EVQLVESGGGLVQAGGSLRLSCVVSGIPSSIRAMAWYRQAPGRQRDW
VATIYSPSGSAVYADSVKGRFTISSDNAKSTIYLQMNSLEPDDTAVYYCRDVNREYWGQGTQVTVSS

<15G5, SEQ ID NO: 2162; PRT; ->
EVQLVESGGGLVQAGGSLRLSCVVSGIPSTIRAMAWYRQAPGRQRDW
VATIYSPSGSAVYADSVKGRFTISSDNAKKTIYLQMNSLKPDDTAVYYCRDVNREYWGQGTQVTVSS

<13C4, SEQ ID NO: 2163; PRT; ->
EVQLVESGGGLVQAGGSLRLSCVVSGIPSSIRAMAWYRQAPGRQRDW
VATIYSPSGSAVYADSVKGRFTISSDNAKSTIYLQMNSLKPDDTAVYYCRDVNREYWGQGTQVTVSS

<46G1, SEQ ID NO: 2164; PRT; ->
EVQLVESGGGLVQAGGSLRLSCAASGRTFSDDAMGWFRQAPGKEREC
VASLYLNGDYPYYADSVKGRFTISRDNAKNAVILQMNNLKTEDTAVYYCAAKPGWVARDPSQYNYWGQGTQVTVSS

<46E4, SEQ ID NO: 2165; PRT; ->
EVQLVESGGGLVQAGGSLRLSCAASGRAFKDDAVGWFRQAPGKEREC
VASMYLDGDYPYYADSVKGRFTISRDNAKNAVILQMNNLKTEDTAVYYCAAKPGWVARDPSEYNYWGQGTQVTVSS

<17B5, SEQ ID NO: 2166; PRT; ->
EVQLVESGGGLVQTGGSLRLSCAASGSTFRTDMMGWYRQAPGKQREF
VASITKFGSTNYADSVKGRFTISNDNAKDTVYLQMNSLKSEDTAVYYCRNFNRDLWGQGTQVTVSS

<15C9, SEQ ID NO: 2167; PRT; ->
EVQLVESGGGLVQAGGSLKLSCVNSGIPSTLRAMAWYRQAPGRQRDW
VATSSNTGGTTYDDSVKGRFTISRDNAKNTVYLQMNSLKPEDTGVYYCRDVNRDLWGQGTQVTVSS

<13D10, SEQ ID NO: 2168; PRT; ->
EVQLVESGGGLVQPGGSLRLSCAASSVITLDSNAIGWFRQAPGKERE
EVSCIASSDGSTYYAESVKGRFTISKDYTRNTVYLQVNSLKPEDTAVYHCATDANPNCGLNVWNSWGQGTQVTVSS

<17C6, SEQ ID NO: 2169; PRT; ->
EVQLVESGGGLVQAGGSLTLSCAASGSTSSLDIMAWYRQAPEKQREL
VASVSGGNSDYASSVKGRFTISGDTAKSTLYLQMNSLKPEDTAMYYCYGRDYYYMPFWGQGTQVTVSS

<15A2, SEQ ID NO: 2170; PRT; ->
EVQLVESGGGLAQAGGSLSLSCAASGRFFSTRVMAWYRQTPGKQREF
VASMRGSGSTNYADSARGRFAISRDNAKNTVYLQMNSLKPEDTAVYYCRDINEDQWGQGTQVTVSS

<17A8, SEQ ID NO: 2171; PRT; ->
EVQLVESGGGLVQAGGSLSLSCAASGRFFSTRVMAWYRQTPGKQREF
VASMRGSGSTNYADSVRGRFAISRDNAKNMVYLQMNTLKPEDTAVYYCRDINEDQWGQGTQVTVSS

<15G10, SEQ ID NO: 2172; PRT; ->
EVQLVESGGGLVQAGGSLSLSCAASGRFFSTRVMAWYRQTPGKQREF
VASMRGSGSTNYADSARGRFAISRDNAKNTVYLQMNSLKPEDTAVYYCRDINEDQWGQGTQVTVSS

<27A3, SEQ ID NO: 2173; PRT; ->
EVQLVESGGGLVQAGGSLSLSCVASGRFFSTRVMAWYRQTPGKQREF
VASMRGSGSTNYADSVRGRFAISRDNAKNTVYLQMNTLKPEDTAVYYCRDINEDQWGQGTQVTVSS

<17H10, SEQ ID NO: 2174; PRT; ->
EVQLVESGGGLVQAGGSLSLSCSASGRFFSTRVMAWYRQTPGNQREF
VATIHSSGSTIYADSVRGRFAISRDNAKNTVYLQMRSLKPEDTAVYYCRDINADQWGQGTQVTVSS

<30D10, SEQ ID NO: 2175; PRT; ->
EVQLVESGGGLVQAGGSLTLSCTASETTVRIRTMAWYRQPPGNQREW
VATIGSNGFATYPDSVKGRFTISRDNAKNTVYLQMNSLKPEDTAVYYCRDINRDIWGQGSQVTVSS

<15H4, SEQ ID NO: 2176; PRT; ->
EVQLVESGGGLVQAGGSLTLSCAPSESTVSFNTVAWYRQAPGEQREW
VATISRQGMSTYPDSVKGRFTISRDNAKNTVYLQMNNLKPEDTAVYYCRDINHDIWGRGSQVTVSS

TABLE B-1-continued

Preferred Nanobodies against HER2 obtained as described in Example 3

<Name, SEQ ID #; PRT (protein); ->

<17B7, SEQ ID NO: 2177; PRT; ->
EVQLVESGGGLVQAGGSLRLSCAASGIISSFRTMAWYRQAPGKQRDW
VATIGSDGLANYADSVKGRFTISRDNAKKTVYLQMNSLKPEDTAVYFCRDINRDYWGQGTQVTVSS

<15D2, SEQ ID NO: 2178; PRT; ->
EVQLVESGGGLVQAGGSLRLSCVVSGVFGPIRAMAWYRQAPGKQRDW
VATIGSSGHPVYTDSVKGRFTFSKDGAKNTVYLQMNSLKPEDTAVYYCRDINRDYWGQGTQVTVSS

<17G5, SEQ ID NO: 2179; PRT; ->
EVQLVESGGGLVQPGGSLRLSCAASGIGIAFSSRTMAWYRQAPGKQRDW
VATIGSGGTTNYADSVKGRFTISRDNAKNTVYLQMNSLKPEDTAVYYCRDINRDYWGQGTQVTVSS

<15B6, SEQ ID NO: 2180; PRT; ->
EVQLVESGGGLVQPGGSLRLSCAASGIIGSFRTMAWYRQAPGNQRDWVA
TIGSAGLASYADSVRGRFTLSRDNAKKTVYLQMNSLKPEDTAIYYCRDINGDYWGQGTQVTVSS

<27F2, SEQ ID NO: 2181; PRT; ->
EVQLVESGGGLVQAGGSLRLSCAASGIISSFRTLAWYRQAPGKQRDWVA
TISSAGGTAYADAVKGRFTISISRDNVEYTVDLQMDSLKPEDTAVYYCRDINGDYWGQGTQVTVSS

<17F5, SEQ ID NO: 2182; PRT; ->
EVQLVESGGGLVQPGGSLRLSCAASGLGIAFSRRTMAWYRQAPGKQRDWVA
TIAGDGSTVYADSMKGRFTISRDNAKNTVYLQVNSLKPEDTAVYYCWDTNGDYWGQGTQVTVSS

<17B2, SEQ ID NO: 2183; PRT; ->
EVQLVESGGGLVQPGGSLRLSCAGSGFTFSNYAMTWVRQAPGKGLEW
VSGVGGDGVGSYADSVKGRFTISRDNAKNTLYLQMNSLKPEDTALYYCTKDISTFGWGPFDYWGQGTQVTVSS

<27H4, SEQ ID NO: 2184; PRT; ->
EVQLVESGGGLVQAGGSLRLSCVASKMTFMRYTMGWYRQAPGKQRDL
VASIDASGGTNYADSVKGRFTISRDNAKNTVYLEMNSLKPEDTGVYYCNGRWDIVGAIWWGQGTQVTVSS

<13A4, SEQ ID NO: 2185; PRT; ->
EVQLVESGGGLVQAGGSLRLSCVASKMTFMRYTMGWYRQAPGKQRDL
VASIDSSGGTNYADSVKGRFTISRDNAKNTVYLEMNSLKPEDTGVYYCNGRWDIVGAIWWGQGTQVTVSS

<2A1, SEQ ID NO: 2186; PRT; ->
EVQLVESGGGLVQAGGSLRLSCVASKITFRRYIMDWYRQAPGKQREL
VASINSDGSTGYTDSVKGRFTISRDNTKNTLDLQMNSLKPEDTAVYYCHGRWLEIGAEYWGQGTQVTVSS

<15E10, SEQ ID NO: 2187; PRT; ->
EVQLVESGGGLVQAGGSLKLSCVASGITFFRYTMGWYRQAPGKEREL
VAEISSADEPSFADAVKGRFTISRDNAKNTVVLQMNGLKPEDTAVYYCKGSWSYPGLTYWGKGTLVTVSS

<27E7, SEQ ID NO: 2188; PRT; ->
EVQLVESGGGLVQAGGSLRLSCAASGITFRRYDMGWYRQFPGKEREL
VATILSEGDTNYVDPVKGRFTISRDNAKNTVYLQMNDLKPEDTAVYYCNGVWRAIGRTYWGQGTQVTVSS

<47E5, SEQ ID NO: 2189; PRT; ->
EVQLVESGGGLVQAGGSLRLSCAASASIFGFDSMGWYRQAPGNERIL
VAIISNGGTTSYRDSVKGRFTIARDNAKNTVSLQMNSLKPEDTAVYYCNLDRRSYNGRQYWGQGTQVTVSS

<2G4, SEQ ID NO: 2190; PRT; ->
EVQLVESGGGLVQAGGSLRLSCAASGNIFSHNAMGWYRQAPGKQREL
VTYITINGIANYVDSVKGRFTISRDNTKNTMYLQMVSLKPEDTAVYYCNVGGREYSGVYYYREYWGQGTQVTVSS

<14D4, SEQ ID NO: 2191; PRT; ->
EVQLVESGGGLVQAGDSLRLSCAASGRALDTYVMGWFRQAPGDGREF
VAHIFRSGITSYASSVKGRFTISRDNAKNTVYLQMASLKPEDTAAYYCAARPSDTTWSESSASWGQGTQVTVSS

<17A5, SEQ ID NO: 2192; PRT; ->
EVQLVESGGGLVQPGGSLRLSCAASGFTFDDYSMSWVRQATGKGLEW
VSGISWNGGSTNYADSVKGRFTISRDNVKNTLYLQMNSLKSEDTAVYYCAKDLGNSGRGPYTNWGQGTQVTVSS

<15D10, SEQ ID NO: 2193; PRT; ->
EVQLVESGGGLVQPGGSLKLSCAASGFTFSSYRMYWVRQAPGKGLEW
VSAIKPDGSITYYADSVKGRFTISRDNAKNTVYLQMNSLKPEDTAVYYCATDCGVPGFGWTFSSWGQGTQVTVSS

<13C2, SEQ ID NO: 2194; PRT; ->
EVQLVESGGGLVQAGGSLRLSCAASGSTFSINRMAWYRQSPGKQREL
VAAVDNDDNTEYSDSVAGRFTISRDNAKNAVHLQMNSLRLEDTAVYYCNAKQLPYLQNFWGQGTQVTVSS

<17G11, SEQ ID NO: 2195; PRT; ->
EVQLVESGGGLVQAGGSLRLSCAASGSTFSINRWGWYRQAPGKQREL
VAAIDDGGNTEYSDFVNGRFTISRDNPETAVHLQMNSLKLEDTAVYYCNAKQLPYLQNFWGQGTQVTVSS

TABLE B-1-continued

Preferred Nanobodies against HER2 obtained as described in Example 3

<Name, SEQ ID #; PRT (protein); ->

<17A3, SEQ ID NO: 2196; PRT; ->
EVQLVESGGGLVQAGGSLSLSCAASATLHRFDNNWYRQAPGKQREL
VATIAHDGSTNYANSVKGRFTISRDNARDTLFLQMHALQPEDTAVYMCNLHRWGLNYWGQGTQVTVSS

<27B7, SEQ ID NO: 2197; PRT; ->
EVQLVESGGGLVQPGGSLRLSCAASGFTFSSYAMSWVRQAPGKGLEW
VSAISSGGGSITTYADSVKGRFTISRDNAKNTLYLQMSSLKPEDTALYYCAKARSSSSYYDFGSWGQGTQVTVSS

<17A6, SEQ ID NO: 2198; PRT; ->
EVQLVESGGGLVQPGGSLRLSCAASGFTFSSYAMSWVRQAPGKGLEW
VSAISSGGGSITTYADSVKGRFTISTDNAKNTLYLQMSSLKPEDTALYYCAKARSSSSYYDFGSWGQGTQVTVSS

<17D7, SEQ ID NO: 2199; PRT; ->
EVQLVESGGGLVQPGGSLRLSCAASGFTLDYCAIGWFRQAPGKEREG
VSCISSSDGSTYYADSVKGRFTISRDNAKNTVYLQMNSLKPEDTAVYYCATDRGSGTCYADFGSWGQGTQVTVSS

<46D4, SEQ ID NO: 2200; PRT; ->
EVQLVESGGGLVQPGGSLRLSCAASGFIFDDYAMSWVRQAPGKGLEW
VSSINWSGTHTDYAEDMKGRFTISRDNAKKTLYLQMNSLQSEDTAVYYCAKGWGPAVTSIPVATLGTQVTVSS

<27B3, SEQ ID NO: 2201; PRT; ->
EVQLVESGGGLVQAGGSLTLSCTASETTVRIRTMAWYRQPPGNQREW
VATIGSNGFATYPDSVKGRFTISRDNAKNTVYLQMNSLKPEDTAVYYCRDINRDIWGQGSQVTVSS

<27E5, SEQ ID NO: 2202; PRT; ->
EVQLVESGGGLVQAGGSLTLSCTASETTVRIRTMAWYRQPPGNQREW
VATIGSNGFATYPDSVKGRFTISRDNAKNTVYLQMNSLKPEDTAVYYCRDINRDIWGQGSQVTVSS

<27D6, SEQ ID NO: 2203; PRT; ->
EVQLVESGGGLVQAGGSLTLSCTASETTVRIRTMAWYRQPPGNQREW
VATIGSNGFATYPDSVKGRFTISRDNAKNTVYLQMNSLKPEDTAVYYCRDINRDIWGQGSQVTVSS

<30D10, SEQ ID NO: 2204; PRT; ->
EVQLVESGGGLVQAGGSLTLSCTASETTVRIRTMAWYRQPPGNQREW
VATIGSNGFATYPDSVKGRFTISRDNAKNTVYLQMNSLKPEDTAVYYCRDINRDIWGQGSQVTVSS

<47G11, SEQ ID NO: 2205; PRT; ->
EVQLVESGGGLVQPGGSLRLSCAASGRIFYPMGWFRQAPGKEREFVA
AIGSGDIITYYADSVKGRFTISRDNAKNTVYLQMNSLKPEDTAVYYCASSRDYSRSRDPTSYDRWGQGTQVTVSS

<27C3, SEQ ID NO: 2206; PRT; ->
EVQLVESGGGLVQPGGSLRLSCAASGFTFDDYATSWVRQAPGKGPEW
VSAINSGGGSTYYADSVKGRFTISRDNAKNTLYLQMNSLKPEDTAVYYCARPRGSSLYLLEYDYWGQGTQVTVSS

TABLE B-2

Preferred Nanobodies against HER2 obtained as described in Example 4

<Name, SEQ ID #; PRT (protein); ->

<11A101/1-120, SEQ ID NO: 2207; PRT; ->
EVQLVESGGGLVQAGGSLRLSCAASGRTFNAMGWFRQAPGKEREFVAAISRS
PGVTYYADSVKGRFTTSRDNAKNTVYLQMNDLKPEDTAVYYCAADFYLATLAHEYDYWGQGTQVTVSS

<11A22/1-122, SEQ ID NO: 2208; PRT; ->
EVQLVESGGGLVQAGGSLRLSCAASGRTFSSYAMAWFRQAPGTEREFIAGIRW
SDGSTYYADSVKGRFTISRDNAKNTVYLQMNSLKPEDTAVYYCAADFYVSTLAHEYDYWGQGTQVTVSS

<12D44/1-122, SEQ ID NO: 2209; PRT; ->
KVQLVESGGGLVQAGGSLRLSCAASGRTFSSYAMAWFRQAPGTEREFIAGIRW
SDGSTYYADSVKGRFTISRANAKNTVYLQMNGLKPEDTAVYYCAADFYVSTLAHEYDYWGQGTQVTVSS

<12E11/1-122, SEQ ID NO: 2210; PRT; ->
EVQLVESGGGLVQAGGSLRLSCAASGRTFSSYAMAWFRQAPGKEREFVGGIRW
SDGSTYYADSVKGRFTISRDNAKITVYLQMNSLKPEDTAVYYCAADFYVSTLAHEYDYWGQGTQVTVSS

<13G111/1-123, SEQ ID NO: 2211; PRT; ->
EVQLVESGGGLVQAGGSLRLSCAASGRTFSSYAMGWFRQAPGKERAFVAAIRW
SGGNTYYADSVKGRFTISRDNAKNTVYLQMNSLKPEDTAVYYCAADTFTLSTLSHEYDYWGQGTQVTVSS

TABLE B-2-continued

Preferred Nanobodies against HER2 obtained as described in Example 4

<Name, SEQ ID #; PRT (protein); ->

<13F71/1-123, SEQ ID NO: 2212; PRT; ->
EVQLVESGGGLVQAGGSLRLSCVASGRTFSNYALAWFRQAPGKEREFVAAINW
RSGGSTYYADSVKGRFTISRDNAKNTVYLQMNSLKPEDTAVYYCAADLIVATLPGEYDYWGQGTQVTVSS

<14H61/1-122, SEQ ID NO: 2213; PRT; ->
EVQLVESGGGLVQAGGSLRLSCAASGRTFSRFAMGWFRQAPGKEREFVAAVRW
SDDYTYYADSVKGRFTISRDNAKNTVYLQMNSLSPEDTAVYYCAADEILATLPHEYDYWGQGTQVTVSS

<22B12/1-124, SEQ ID NO: 2214; PRT; ->
EVQLVESGGGLVQAGGSLRLSCAASGRTFSSYAMAWFRQAPGKEREFVAGINK
SGGITHSADSVKGRFTISRDNAKNTVYLQMNSLKPEDTAVYYCAADAYTVIATLPHEYDYWGQGTQVTVSS

<14H71/1-123, SEQ ID NO: 2215; PRT; ->
EVQLVESGGGLVQAGGSLRLSCEASGLTISSLTMAWFRQAPGKEREFVANIK
WSGDRIVYADSVKGRFTISRDSAKNAVNLQMELVESDDTAVYYCAAKHSTVAGLTHEYDYWGQGTQVTVSS

<12D51/1-120, SEQ ID NO: 2216; PRT; ->
EVQLVESGGGLVQPGGSLRLSCAASGSAFSIKSMGWYRQAPGKQRELAAVII
SSGTTTYADSVKGRFTISRDSAKNTVYLQMDSLKPEDTAVYYCNAVYVSTWGNGYDYWGQGTQVTVSS

<11A111/1-126, SEQ ID NO: 2217; PRT; ->
EVQLVESGGGLVQAGGSLGLSCAAAGRTFSSSLMGWFRQAPGKEREFVAAIT
DNGGSTYYADSVKGRFTISRDNAKNSVYLQMNSLKPEDTAIYYCAARRSGYYSLSTSPHQYAYWGQGTQVTVSS

<13G71/1-124, SEQ ID NO: 2218; PRT; ->
EVQLVESGGGLVQAGGSLRLSCAASGRAFSSYAMGWFRQAPGKERDFVAAIT
SSGSTNYADSVKGRFTISRDNAKNTVYLQMNSLKPEDTAVYYCGARVNYAAYSRLEHDYHYWGQGTQVTVSS

<13G74/1-125, SEQ ID NO: 2219; PRT; ->
EVQLVESGGGLVQAGGSLRLSCATSGRTFSTYASMGWFRQTPGKEREFVAAI
TSSGSTNYADSVKGRFTISRDNAKNTVYLQMNSLKPEDTAVYYCGARVNYAAYSRLEHDYHYWGQGTQVTVSS

<11A71A/1-116, SEQ ID NO: 2220; PRT; ->
EVQLVESGGGLVQPGGSLRLSCAASGNIDGIITMGWYRQRPGKPREWVGTIN
SGGDTNYAGSVKGRFTIARDDAKNTMYLQMNGMKPEDTAVYYCKMNRAGIYEYWGQGTQVTVSS

<22B101/1-123, SEQ ID NO: 2221; PRT; ->
EVQLVESGGGLVQTGGSLRLSCAASGPTFSDYAIGWFRQAPGKEREFVAAIS
SSGISTIYGDSVKGRFDISRDNAKNTVYLQMNRLKPEDTAVYYCAARLFMATPNQGQYYYWGQGTQVTVSS

<11B42/1-123, SEQ ID NO: 2222; PRT; ->
EVQLVESGGGLVQAGDSLRLSCAARSGFTFSNHIMGWFRQAPGKERELIAEI
TWNGGSTYYADSVKGRFAISRDNALNTVYLQMNSLKPEDTAVYYCAARPSYSTNNVKSYRYWGQGTQVTVSS

<13E111/1-124, SEQ ID NO: 2223; PRT; ->
EVQLVESGGGLVQAGSSLRLSCALSGRTFSDYAIGWFRQAPGKEREFVAAIS
GWSGGTTNYADSVKGRFTISRDNGKNTVDLRMNSLKPEDTAVYYCAARPAVVHTRKESYPYWGQGTQVTVSS

<14H12/1-125, SEQ ID NO: 2224; PRT; ->
EVQLVESGGGLVQAGGSLRLSCIASERTFSSAGVGWFRQAPGKERDFVAAIS
WNGVTIYYADSVKGRFTISRDNAKNTVYLQMNSLKPEDTAVYYCAARINYSVLTTTSSSYHYWGQGTQVTVSS

<13G101/1-123, SEQ ID NO: 2225; PRT; ->
EVQLVESGGGLVQPGDSLRLSCSASEGTLSRSRVAWFRQAPGKEREFVTVI
SGVGTSYADSVKGRFTISRDDAKNTVYLQMNSLKAEDTAIYYCAADFRSTWLSSSGSSYTYWGQGTQVTVSS

<13G41/1-121, SEQ ID NO: 2226; PRT; ->
EVQLVESGGGLVQPGGSLTLSCVGSGRRFSADVMGWYRQAPGKQREFVASI
SSGSAINYADSVKGRFTVSRDNAQNTVYLQMNSLKIEDTGVYYCNARRIVNVEGAYRDYWGQGTQVTVSS

<22B910/1-121, SEQ ID NO: 2227; PRT; ->
EVQLVESGGGLVQPGGSLPLSCAASGSIFRMNDMGWYRQAPGKQRERVATL
TSAGNTNYADSVKGRFTISGDDARNTVYLQMNSLNPEDTAVYYCNAKVVVAVEGAKYDYWGQGTQVTVSS

<21A81/1-122, SEQ ID NO: 2228; PRT; ->
EVQLVESGGGLAQAGGSLRLSCAVFGRSRYGMAWFRRAPGKEREFVAGIAW
NGASIGSADSVRGRFTISRDNSENTVYFEMGSLKPEDTAVYYCAICRISWCAGAESDYGYWGQGTQVTVSS

<21A92/1-127, SEQ ID NO: 2229; PRT; ->
EVQLVESGGGQVQAGGSLRLSCTESGRAFNTRAMGWFRQAPEKEREFVAGI
TMSGFNTRYADSVKGRFTISRDNAKGTVYLQMSSLKPEDTAVYYCAADSITDRRSVAVAHTSYYYWGQGTQVTVSS

<22C712/1-123, SEQ ID NO: 2230; PRT; ->
EVQLVESGGGLVQAGGSLGLSCAASGRTFSNYAMGWFRQAPGKEREFVAGI
SWSGGHTFYADSVKGRFTISRDNTKNTVYLQMNSMRPEDTAVYYCAARLSSVAVASTRYDYWGQGTQVTVSS

TABLE B-2-continued

Preferred Nanobodies against HER2 obtained as described in Example 4

<Name, SEQ ID #; PRT (protein); ->

<11A13/1-125, SEQ ID NO: 2231; PRT; ->
EVQLVESGGGLVQAGDSLRLSCVASGGTFGSYAMGWFRQAPGKEREFVATI
DWSGDTAFYADSVKGRFTISRDIANDVVYLQMNSLEPEDTAVYYCARNRQSGVASENLRLYTYWGQGTQVTVSS

<13G93/1-123, SEQ ID NO: 2232; PRT; ->
EVQLVESGGGLAQAGDSLRLSCVDSGSSFSAYAMGWFRQAPGKEREFVAAV
SWDGRNTYYADSVKGRFTISRDNAKNTLYLQTTSLRPEDTGVYYCAEDKQSGVSVNPKYAYWGQGTQVTVSS

<12C52/1-118, SEQ ID NO: 2233; PRT; ->
EVQLVESGGGLVQAGGSLRLSCAVSGGTFESDTMAWFRQAPGKEREFVARV
SWIRTTYYSDSVKGRFTISKDNAKNTVYLQMNSLKPEDTAVYYCAAQTLGRSLYDYWGQGTQVTVSS

<12C61/1-126, SEQ ID NO: 2234; PRT; ->
EVQLVESGGGLVQAGGSLRLSCAASGRTFSSNAMAWFRQAPGNERELVSAI
GWSGASTYYIDSVEGRFTISRDNAKNTVYLQMNSLKPEDTAVYYCAASRYSGGVATARRSEYHYWGQGTQVTVSS

<21A61/1-125, SEQ ID NO: 2235; PRT; ->
EVQLVESGGGLVQAGDSLRLSCVASGDSFNTYTMGWFRQAPGKEREFVAAI
RWSGGTTFYGDSVKGRFTISRDYAKNTWYLQMNTLKPEDTAAYYCAAVATYSRNVGSVRNYDYWGQGTQVTVSS

<11A121/1-126, SEQ ID NO: 2236; PRT; ->
EVQLVESGGGLVQAGGSLRLSCVVSEGTFSSYSMGWFRQAPGKDREFVSAI
TWNGTRTYYRDSVKGRFTISRDNAKNTVQLQMNSLKPEDTAVYYCAVSQPLNYYTYYDARRYDYWGQGTQVTVSS

<11A91/1-124, SEQ ID NO: 2237; PRT; ->
EAQLVESGGGLVQAGGSLRLSCTASGRTYSTIMGWFRQAPGKEREFVAAIR
WSGGSAFYADSVKGRFTISRDNAKNTVYLQMTSLMPEDTAVYYCADTPVYYQRYYDQNAYDYWGQGTQVTVSS

<13G72/1-118, SEQ ID NO: 2238; PRT; ->
EVQLVESGGGLVQAGGSLRLSCAASGRAFSSYAMGWFRQAPGKERDFVAAI
TSSGSTNYADSVKGRFTISRDNAKNTVYLQMNSLKPEDTAVYYCAAKYYSYYAYDYWGQGTQVTVSS

<13E81/1-124, SEQ ID NO: 2239; PRT; ->
EVQLVESGGGLVQAGGSLRLSCAASGGTFSVYHMAWFRQAPGKEREFVAAI
RSSGGLFYALSVSGRFTISRDNAKDTMYLQMNVLKPEDTAVYYCAASPVYYIDYSSQYKYGYWGQGTQVTVSS

<11B31/1-124, SEQ ID NO: 2240; PRT; ->
EVQLVESGGGLVQAGGSLRLSCAASGGAFGVYHMGWFRQAPGKEREFVAAI
RSGGTTLYEDSVKGRFTISRDNAKNTVYLRMNSLKPEDTAVYYCATQIYYRTNYYSQNAYDYWGQGTQVTVSS

<13G81/1-124, SEQ ID NO: 2241; PRT; ->
EVQLVESGGGLVQAGGSLRLSCAASGGTFGVYHMGWFRQAPGKEREFVAVI
RSGGTTLYADSVKGRFTISRDDAKNTVYLQMNSLKPEDTAVYLCAAQIYYRTNYYSQNNYDYWGQGTQVTVSS

<21A53/1-124, SEQ ID NO: 2242; PRT; ->
EVQLVESGGGLVQAGGSLELSCAASGGAFGVYHMGWFRQAPGKEREFVAAI
RSGGTTLYEDSVKGRVTISRDDAKNTVYLRMNSLKPEDTAVYYCAAQIYYRTNYYSQNVYDYWGQGTQVTVSS

<14H51/1-124, SEQ ID NO: 2243; PRT; ->
EVQLVESGGGLVQAGGSLRLSCAASGGTFGVYTMAWFRQAPGKEREFVAAI
RSGATTLYEDSVKGRFTISRDDAKNTVYLRMNSLKPEDTAVYYCAAQIYYRTNYYSQNEYDYWGQGTQVTVSS

<21A21/1-124, SEQ ID NO: 2244; PRT; ->
EVQLVESGGGLVQAGGSLRLSCAASGGTFGVYHMGWFRQAPGTEREFVAVI
RSGGTTLYEDSVKGRFTISRDNAKNTVYLRMNSLKPEDTAVYYCAAQIYYRTNYSSQSNYDYWGQGTQVTVSS

<21A111/1-124, SEQ ID NO: 2245; PRT; ->
EVQLVESGGGLVQAGGSLKLSCAVSGRTIVPYTMAWFRQAPGKEREFVAV
TRSGGTTFYADSAKGRFTIARDDAKNTVYLQMNSLKPEDTAVYYCALATAYRTNYSSRDKYDYWGQGTQVTVSS

<22B1212/1-122, SEQ ID NO: 2246; PRT; ->
EVQLVESGGGLVQPGGSLRLSCAASGFTFSSYAMSWVRQAPGKGLEWVSAI
NSGGGSTSYADSVNGRFTISRDNAKNTLYLQMNSLKPEDTAVYYCAKYLSFYSDYEVYDYWGQGTQVTVSS

<11A31/1-120, SEQ ID NO: 2247; PRT; ->
EVQLVESGGGLVQAGGSLRLSCAASGGTFSSGVMAWFRQSPGEEREFLALI
TRNGETKKTADSVKGRFTISRDNAKNGVSLQMDSLKAEDTAVYYCASDPTYGSGRWTYWGQGTQVTVSS

<13E51/1-128, SEQ ID NO: 2248; PRT; ->
EVQLVESGGGLNQAGGSLRLSCAASRHTFSGYAMGWFRQAPGKEREFVAAI
RWSGGITYYADSVKGRFTISSDNAKNTVYLQMNSLKPEDTALYYCARSVTYYSGSHAYTQEGGYARWGQGTQVTVSS

<12D121/1-126, SEQ ID NO: 2249; PRT; ->
EVQLVESGGGLVQTGGSLRLSCAASGRAFSTYGMGWFRQAPGKAREFVAAI
SRSGTGTYYAGSMKGRFTISRDDAKNTVYLQMNSLKPEDTAVYYCAARQPYASGSHYSSTQYTYWGQGTQVTVSS

TABLE B-2-continued

Preferred Nanobodies against HER2 obtained as described in Example 4

<Name, SEQ ID #; PRT (protein); ->

<13F121/1-119, SEQ ID NO: 2250; PRT; ->
EVQLVESGGGLVQAGGSLRLSCAASGRSFNDYTMGWFRQTPGKEREFVARV
WWNGGSAYYADSVKGRFTISIDNAKNTVYLQMNNLTPEDTAVYYCAALYRGRSVYDDWGQGTQVTVSS

<13G121/1-127, SEQ ID NO: 2251; PRT; ->
EVQLVESGGGLVRAGTSLRLSCADSARTFSSAAMGWFRQAPGKEREFVSAI
SPIGSSKYYADSVKGRFTISRDNAKNTVYLQMDSLKPEDTAVYYCAASSYGSTYYSQGRAYYYDYWGQGTGVTVSS

<22B41/1-124, SEQ ID NO: 2252; PRT; ->
EVQLVESGGGLVQPGGSLRLSCTVFGRTFSGDVIGWFRQAPGKEREFVAAI
STSGGGTDSADSVKGRFTISKENAKNTVYLQMTILKPEDTAVYYCASSPYGPLYRSTHYYDYWGQGTQVTVSS

<12D71/1-125, SEQ ID NO: 2253; PRT; ->
EVQLVESGGGLVQAGGSLGLSCAASGRTVSTMGWFRQAPGKEREFVTAITW
SGDSTNFADSVKGRFTISRDSAKDTVYLQMNNLKPEDTAVYYCAATTYYSGSYISTLSTSYNYWGQGTQVPVSS

<13F42/1-111, SEQ ID NO: 2254; PRT; ->
EVQLVESGGGLVQAGGSLRLSCVASGRTLSTTGVGWFRQAPGKGRESVATI
FVGGTTYYSDSVKGRFTISRDNAKNAVNLQMSNLKPEDTALHYCTICSYRGQGTQVTVSS

<12C101/1-111, SEQ ID NO: 2255; PRT; ->
EVQLVESGGGLVQAGGSLRLSCVASGRTLSTTGVGWFRQAPGKERESVATI
FVGGTTYYSDSVKGRFTISRDNARNAVNPQMNNLKPEDTAVYYCTIGSYRGQGTQVTVSS

<14H91/1-127, SEQ ID NO: 2256; PRT; ->
EVQLVESGGGLVQAGGSLRLSCAASGRTFSRDVMGWFRQAPGKEREFVAAK
TWSGASTYYADSVRGRFTISRDNAKNAVYLQMNSLKPEDTAVYYCAARDSSTLDSTYYVGGSYNYWGRGTQVTVSS

<13F41/1-111, SEQ ID NO: 2257; PRT; ->
EVQLVESGGGLVQAGGSLRLSCVASGRTLSTTGVGWFRQAPGKERESVATI
FVGGTTYYSDSVKGRFTISRDNAKNAVNLQMSNLKPEDTALYYCTIGSYRGQGTQVTVSS

<14H21/1-125, SEQ ID NO: 2258; PRT; ->
EVQLVESGGGLVQGGSLRLSCVRSGGYFGSYHIGWFRQAPGNEREFVAAI
TWNGASTSYADSVKGRFTISRSIAENTVYLQMNKVKPEDTAVYYCAARMYGSDWLPRPEDFDSWGQGTQVTVSS

<22B610/1-120, SEQ ID NO: 2259; PRT; ->
EVQLVESOGGLVQPGGSLRLSCAASGSIFSINAMGWYRPAPOKQRELVARI
TSTGSTNYADSVKGRFTISRDNAKNTVYLQMNSLKPEDTAVYYCNADVSPSYGSRWYGWGQGTQVTVSS

<12C32/1-127, SEQ ID NO: 2260; PRT; ->
EMQLVESGGGLVQAGGSLRLSCATSERTFSTYTMAWFRQAPGKEREFVVAI
KSSDNSTSYRDSVKGRFTISRDNAKSTMYLQMNSLKPEDTAVYYCAARREYSTIYTARYPGEYVYWGQGTQVTVSS

<12D61/1-116, SEQ ID NO: 2261; PRT; ->
EVQLVESGGGLVQPGGSLRLSCAASRSIFSPNVVGWYRQAPGKQRELVAAV
TSGGITNYADSVKGRFTISRDNAKNTLYLQMNSLKAEDTAVYYCNARERGIYDSWGQGTQVTVSS

<13G31/1-125, SEQ ID NO: 2262; PRT; ->
EVQLVESGGGLVQAGGSLRLSCAASGGTFSRYKMGWFRQAPGKEREFVAAS
RWSGGIKYHADSVKGRFTISRDDAKNSIYLQMNTLKPEDTAVYYCAADDYLGGDNWYLGPYDSWGQGTQVTVSS

<22C65/1-124, SEQ ID NO: 2263; PRT; ->
EVQLVESGGGLVQAGGSLRLSCAVSGFLFDSYAMGWFRQAPGKEREFVAAI
RWSGSATDYSDSVKGRFTISRDNAKNTVYLQMNSLIPEDTAVYYCAARKTYRSLTYYGEYDSWGQGTQVTVSS

<11A71/1-125, SEQ ID NO: 2264; PRT; ->
EVQLVESGGGLVQPGGSLRLSCAASRSIRSVSVMGWYRLAPGNQRELVATI
TADGITNYADSVKGRFTVSRDNGRNTVYLQMNSLKPEDTAVYYCNVDRLLYYSSGYYQTSVDVWGQGTQVTVSS

<11B91/1-125, SEQ ID NO: 2265; PRT; ->
EVQLVESGGALVQPGGSLRLSCAASGSIRSINTMGWYRQAPGNQREFVAAV
TEGGTTSYAASVKGRFTISRDKAKNTVLLQMDSLKPEDTAVYYCNADRFLYYSAGRYDTGSDIWGQGTQVTVSS

<11A81/1-125, SEQ ID NO: 2266; PRT; ->
EVQLVESGGALVQPGGSLRLSCAASDSIRSINIMGWYRQAPGKQREFVAAV
TEDGSINYAESVKGRFTISRDKAKNALYLQMNSLKPEDMAVYYCNADRVLYYSDSRYYTGSNYWGQGTQVTVSS

<11B121/1-127, SEQ ID NO: 2267; PRT; ->
EVQLVESGGGLVQPGGSLRLSCAASGSSASINTMGWYRQAPGEQRELVAEI
TEGGIINYTDSVKGRFTISRDNAKNTVYLEMNNLKPEDTAVYYCNADRALYRNYSDGRYYTGYDYWGQGTQVTVSS

<12D31/1-115, SEQ ID NO: 2268; PRT; ->
EVQLVESGGGLVQPGGSLRLSCAASRNIFDFNDMGWYRQGPKEREFVALI
NVGGVAKYEDSVKGRFTISRDNAENTVYLQMNNLKPEDMAVYYCNARILSRNYWGQGNQVTVSS

TABLE B-2-continued

Preferred Nanobodies against HER2 obtained as described in Example 4

<Name, SEQ ID #; PRT (protein); ->

<11B51/1-127, SEQ ID NO: 2269; PRT; ->
EVQLVESGGGLVQAGGSLRLSCAASGGTFSGRGMGWFRQAPGKEREFVAAV
SWSGGNTYYADSVKGRFTISRDNAKSTVYLQMDSLKPEDTAVYYCAASRRFYSGLYYYTDDAYEYWGQGTQVTVSS

<13G51/1-127, SEQ ID NO: 2270; PRT; ->
EVQLVESGGGLVQAGGSLSLSCAASGGTFNGRAVGWFRQAPGEEREFVTGI
SWSGGSTDYADSVKGRFTISRDNSKNTVSLQMNSLKPEDTAVYYCAASRRFYSGLVYYSVDAYENWGQGTQVTVSS

<13F82A/1-130, SEQ ID NO: 2271; PRT; ->
EVQLVESGGGLVQAGGSLRLSCAISGRTLSGRAMGWFRQAPGKEREFREF
VAATSWSGGSKYVADSVTGRFTIFRDNAENTAYLQMNSLNPEDTAVYYCAVTKRYYSIKYYSTVEDYEYWGQGTQVTVSS

<13E101/1-128, SEQ ID NO: 2272; PRT; ->
EVQLVESGGGLVQAGGSLRLSCAVSGRTFNNDHMGWFRQAPGTERELVAAT
GRRGGPTYYADSVKGRFTISRDNAESTVYLQMNSLKAEDTAVYYCAANRYYCSTYGCLSTPRQYDYWGQGTQVTVSS

<22B85/1-120, SEQ ID NO: 2273; PRT; ->
EVQLVESGGGLVRPGGSLRLSCATSGSDIGINAMGWYRQAPGNQRELVATI
TGSTGTTYADSVKGRFAISRDGAKNTVYLQMDSLKPEDTAVYYCNLRVYTGTYGGRNYWGQGTQTVSS

<11B12/1-118, SEQ ID NO: 2274; PRT; ->
EVQLVESGGGLVQAGGSLRLSCAASGRALINYAMGWFRQAPGKEREFVSAI
NWSGSHTDYGDSVKGRFAISRDNAKNTVYLQMHSLKPEDTAVYHCATGYSLPAFDSWGPGTQVTVSS

<13G61/1-118, SEQ ID NO: 2275; PRT; ->
EVQLVESGGGVVQAGGSLRLSCAPSGRTFSSYVMGWVRQAPGKAREFVAGI
TRNSGRTRYADSVKGRFTISRDNADNTVTLQMNSLKPEDTAVYYCAGGIDLYTFHYFGQGTQVTVSS

<14H41/1-118, SEQ ID NO: 2276; PRT; ->
EVQLVESGGGLVQAGGSLRLSCAPSGRTFSSYVMGWVRQAPGKAREFVAGI
TRNSIRTRYADSVKGRFTISRDNADNTVTLQMNSLKPEDTAVYYCAGGIDLYTFDYFGQGTQVTVSS

<11B81/1-126, SEQ ID NO: 2277; PRT; ->
EVQLVESGGGLVQGGSLRLSCAASGRPVNNYIMGWFRQALGQGREFVAAI
NRNGATAAYADSVKGRFTISRDNAEDLLYLQMNLLKPEDTAVYYCAANSDSGFDSYSVWAAYEYWGQGTQVTVSS

<11C11/1-121, SEQ ID NO: 2278; PRT; ->
EVQLVESGGGLVQAGGSLRLSCAASGRTFSAYAMGWFRQAPGKERESVATI
RWTGGSSSTSYADSVKGRFTISKNTAENTVYLQMNSLKPEDTAVYYCAVLLTVWDTYKYWGQGTQVTVSS

<12D92/1-123, SEQ ID NO: 2279; PRT; ->
EVQLVESGGGLVQAGGSLRLSCAASGRTYNMAWFRQAPGKEREFVAAMNWS
GGSTKYAESVKGRFTISRANDNNPLYLQMNTLKPEDTAVYYCAATNRWYTGVYDLPSRYEYWGQGTQVTVSS

<13E61/1-123, SEQ ID NO: 2280; PRT; ->
EVQLVESGGGLVQAGGSLRLSCTASGQTFNMGWFRQAPGKEREFVAAISWS
QYNTKYADSVKGRFTISRDNAINSLYLQMDTLKPEDTAVYYCAATNRWFSAVYDLPSRYTYWGQGTQVTVSS

<22B71/1-114, SEQ ID NO: 2281; PRT; ->
EVQLVESGGAFVQGGSLRLSCAASGSDVWFNVMGWYRQGPGQQLELVASI
TYGGNINYGDPVKGRFSISRDNALKTVYLQMNSLKPEDTAVYYCYADLPSRLWGQGTQVTVSS

<21A121/1-123, SEQ ID NO: 2282; PRT; ->
EVQLVESGGGLVQAGGSLRLSCTASGRAFNMGWFRQAPGKEREFVAGVNWG
GGSTKVADSVKERFTISRDYDNSPVYLQMNTLKPEDTAVYYCAATSRWYSAVYDLPTRYDYWGQGTQVTVSS

<13F101/1-124, SEQ ID NO: 2283; PRT; ->
EVQLVESGGGLVQAGGSLRLSCQLSGGTVSDLHMGWFRQAPGKEREFVGFT
RWPSITYIAEHVKGRFTISRDNAKNTVYLQMNSLEREDTAVYYCAADRSYSIDYRHADSYSYWGQGTQVTVSS

<11A43/1-123, SEQ ID NO: 2284; PRT; ->
EVQLVESGGGLVQAGGSLRLSCAASGSIFRVNHMGWYRQAPGKQREFVAAI
TSDHITWYADAVKGRFTISRDNAHNTVTLQMNSLRPEDTAVYYCAADPLLFYGVGSADVDYWGQGTQVTVSS

<12C81/1-117, SEQ ID NO: 2285; PRT; ->
EVQLVESGGGLVQPGGSLRLSCAGSGNIVRDNTMAWYRQAPGNQRDLVATI
NVGGGTYYAGPVKGRFTISRDNAKNSVYLQMNSLKPEDTSVYYCNVISGLVQRDYWGQGTQVTVSS

<11B21/1-124, SEQ ID NO: 2286; PRT; ->
EVQLVESGGGLVQAGGSLRLSCAASGRTFSMYLMGWFRQAPGKEREFVSTI
NRRGGNTYYADSVKGRFTISRDNARNTVYLQMNSLKPEDTAVYYCAAGGHLLGYDVQWEPDYWGQGTQVTVSS

<11B71/1-126, SEQ ID NO: 2287; PRT; ->
EVQLVESGGGLVQAGGSLRLSCAASGRTFERYAMGWFRQAPGKEREFVATI
SWSGGRDTVYADSVKGRFTISRDNAKNTVYLQMNSLKPEDTAVYYCAAHKRTYELGAHSTDFGSWGQGTQVTVSS

TABLE B-2-continued

Preferred Nanobodies against HER2 obtained as described in Example 4

<Name, SEQ ID #; PRT (protein); ->

<12C121/1-126, SEQ ID NO: 2288; PRT; ->
EVQLVESGGDLVQPGESLRLSCAVSGVTVDYSGIGWFRQAPEKEREAVSCI
ESGDCTTTYVDSVKGRFTISRDNAKNAVYLQMNSLKPEDTGVYYCATAVFVDSGDFSVCRGVGYWGKGTQVTVSS

<22C51/1-121, SEQ ID NO: 2289; PRT; ->
EVQLVESGGGLVQAGASLRLSCAASGRTFSRYDIGWFRQAPGKGREFVAAI
NWSGGTTSFGDSVKGRFTISRDNAKNTVYLQMNSLKPEDTAVYYCAALRSWPRGVDSGSWGQGTQVTVSS

<12D11/1-123, SEQ ID NO: 2290; PRT; ->
EVQLVESGGGLVQTGGSLRLSCAASGRTFSGSRMGWFRQAPGKEREFVAAI
RWSGGITWYAESVKSRFTISRDNTKNTIDLQINSLKPEDTAVYYCAADVIYKNIGSGSFDYWGQGTQVTVSS

<12D14/1-123, SEQ ID NO: 2291; PRT; ->
EVQLVESGGGLVQAGGSLRLSCAASGRTFSGSRMGWLRQAPGKEREFVAAV
RWSGGITWYAESVKGRFTISRDNTKNTIDLQINSLKPEDTAVYYCAADVIYKNIGSGSFDYWGQGTQVTVSS

<12C111/1-123, SEQ ID NO: 2292; PRT; ->
EVQLVESGGGLVQAGGSLRLSCAVSGLTFSSYAMGWFRQAPGKVREFVATI
SRSGGRTSYADSVKGRFIVSRDNAKNTADLQMNDLKPEDTAVYYCGASKWYGGFGDTDIEYWGQGTQVTVSS

<22B55/1-123, SEQ ID NO: 2293; PRT; ->
EVQLVESGGGLVQAGGSLRLSCAVSGLTFSTYAMGWFRQAPGKVREFVATI
SRSGGRTSYADSVKGRFIVSRDNAKNTADLQMNELKPEDTAVYYCGASKWYGGFGDTDIEYWGQGTQVTVSS

<14H121/1-113, SEQ ID NO: 2294; PRT; ->
EVQLVESGGGLVQPGGSLRLSCAASGITFRFKAMGWFRQGPGKRRELVARI
AGGSTNYADSVKGRFTISRDDAKNTVFLQMNSLKPEDTAVYYCNVDGPFGNWGQGTQVTVSS

<12C71/1-125, SEQ ID NO: 2295; PRT; ->
EVQLVESGGGLNQAGGSLRLSCTASGGTFGSYALGWFRQSPGKERESVAAI
DWDGSRTQYADSVKGRFTISRENVKDTMYLQMNSLQAEDTGVYYCVRSRHSGNTLSFSLKYDYWGQGTQVTVSS

<21A31/1-125, SEQ ID NO: 2296; PRT; ->
EVQLVESGGGLVQAGGSLRLSCAASEPTFSSVAMGWFRQGPGKEREFAATI
TWSGDSTYVTDSVKGRFTISRDNARNTAYLQMDSLRPEDTAVYSCAARRWSGTLSLFDNEYYYWGQGTQVTVSS

<12C91/1-121, SEQ ID NO: 2297; PRT; ->
EVQLVESGGGLVQAGGSLRLSCVASGRTSSYYHMAWFRQAPGKEREFIAAI
NLSSGSTYYPDSVKGRFTISRGNAKNTVNLQMNSLKPEDTAVYYCAADNYRDSYLEYDYWGQGTQVTVSS

<14H91/1-125, SEQ ID NO: 2298; PRT; ->
EVQLVESGGGLVQAGGSLSLSCAASGRTFSNYRMAWFRQAPRKEREFVAAI
SRSGESTYFADSMKGRFTISRDNTESTGYLQMNNLKPEDTAVYYCAASWDHGDYVDGGFFYDYWGQGTQVTVSS

<12C42/1-124, SEQ ID NO: 2299; PRT; ->
EVQLVESGGGLVQAGGSLRLSCAASGRTFSRYAMHWFRQAPGSERDFVAGI
SWDGGSTFYANSVKGRFTISRDNAKNMVYLQMNSLKPEDTAVYYCAAAGSAGPPSIDRQYDYWGQGTQVTVSS

<12D102/1-118, SEQ ID NO: 2300; PRT; ->
EVQLVESGGGLVQPGGSLRLSCAASGSSLSFNAMGWSREAPGKRRELVARI
ISDDSTLYADSVKGRFTISRDYAKNTAYLQMNSLKPEDTAVYYCVADVRDSIWRSYWGQGTQVTVSS

<11A52/1-120, SEQ ID NO: 2301; PRT; ->
EVQLVESGGGLVQAGGSLRLSCAASGRALSNYAMRWFRQAPGKEREFVATI
NWSGSHTDYADSVKGRFTISRDNAENTVYLQMNSLTPEDTAVYYCASGWGATQAQSGFWGQGTQVTVSS

<14H111/1-120, SEQ ID NO: 2302; PRT; ->
EVQLVESGGGLVQAGGSLRLSCAASGRALISFAMRWFRQAPGKEREFVAAI
NWSGTHTDYADSVKGRFTISRDNAENTVYLLMNSLIPEDTAVYYCATGWGATQAQHGFWGQGTQVTVSS

<11B61/1-120, SEQ ID NO: 2303; PRT; ->
EVQLVESGGGLVQAGGSLRLSCAASGRTSSGYGMGWFRQAPGKEREFVAAV
GWYGSTYFADSVKGRFTIYRDNAQNTMYLQMNSLKPEDTAVYYCAASSSLATISQPSSWGQGTQVTVSS

<12E42/1-118, SEQ ID NO: 2304; PRT; ->
EVQLVESGGGLVQPGGSLRLSCAHSGRAFSLRTMGWYRQAPGNQRELVALI
SAGDSTYYPDSVKGRFTVSRDNAKNTVYLQMNSLKPEDTAVYYCNAKAVTSRDHEYWGQGTQVTVSS

<13F81A/1-128, SEQ ID NO: 2305; PRT; ->
EVQLVESGGGLVQAGGSLRLSCAASGRTFSRYAMGWFRQAPGKEREFVAAI
SWTGGSSYYGDSVKGRSTISRENAENTVYLQMNSLKPEDTAVYYCAANS
DEFYSGTLKLQSRMVEYWGQGTQVTVSS

TABLE B-2-continued

Preferred Nanobodies against HER2 obtained as described in Example 4

<Name, SEQ ID #; PRT (protein); ->

<11B102/1-118, SEQ ID NO: 2306; PRT; ->
EVQLVESGGGLVQAGGSLRLSCAASGGIFSSHAISWFRQAPGKAREFVA
AINWSGSHRDYADSAKGRFTISRDNAKKTAYLQMNSLRPEDTAVYYCVGGWKTDEYVKWGQGTQVTVSS

<21A41/1-120, SEQ ID NO: 2307; PRT; ->
EVQLVESGGGLVQAGGSLRLSCAASGRIFSNYAWSWFRQAPGKERGFVA
AINWSGGYTDYADSVKGRFTISRDNTKNTVYLQMNSLKPEDTAVYYCRPGWVTPSYEYGNWGQGTQVTVSS

<14H101/1-128, SEQ ID NO: 2308; PRT; ->
EVQLVESGGGLVQAGGSLRLSCAASGRTFISSPMGWFRQAPGKEREVVA
ATTRSGGLPYYSDSVKGRFTISRDNAKNTVDLQMSSLKPEDTAAYYCAADQKYGMSYSRLWLVSEYEYWGQGTQVTVSS

<12E21/1-115, SEQ ID NO: 2309; PRT; ->
EVQLVESGGGLVQPGGSLRLSCAASGSIDSIHVVGWYRKAPGKQREVVA
YIGTAGATHYADSVKGRFTISRDNAENLVYLQMNNLKPEDTAVYYCSAGWGDSAYWGQGTQVTVSS

<13F21/1-123, SEQ ID NO: 2310; PRT; ->
EVQLVESGGGLVQSGGSLRLSCVASGTIVSINATSWYRQAPGNQRELVA
TIIGDGRTHYADSVKDRFTISRDAAANLVYLQMNSLKPSDTAIYSCNANGIESYGWGNRHFNYWTVGTQVTVSS

<12E33/1-119, SEQ ID NO: 2311; PRT; ->
EVQLVESGGGMVQAGGSLRLSCAASGLTLSNYGMGWFRQAPGKEREFVS
SINWSGTHTYDADFVKGRFIISRDNAKNTVYLQINSLKPEDTAVYYCAAGGWGTGRYNYWGQGTQVTVSS

<13G11/1-122, SEQ ID NO: 2312; PRT; ->
EVQLVESGGGLVQAGGSLRLSCAASGRTFISNYAMGWFRQAPGKEREFV
ATINWSGSHSDYADSVKGRFTISRDNAKNTVYLQMNNLKSEDTAVYYCAPGWGTAPLSTSVYWGQGTQVTVSS

TABLE B-3

Nanobodies against HER2 obtained as described in Example 4

<Name, SEQ ID #; PRT (protein); ->

<118N121_A1_4_OK/1-127, SEQ ID NO: 2113; PRT; ->
EVQLVESGGGFVQTGGSPRLSCAASGRSFSEYAAAW
FRQSPGKERDLVAGIMWDGRSLFYADSVKGRFTISRDNAKNTLHLQMNS
LKPEDTAVYYCAYHKTPYTTLELNRPHAFGSWGQGTQVTVSS

<118N121_A6_2_OK/1-123, SEQ ID NO: 2313; PRT; ->
EVQLVESGGGLVQAGGSLRLSCVASGRTFSGYSVGW
FRQSPGKEREFVGGINWSGRTYYVDSVKGRFTFSRDNAKNTVYLQMNSLKPEDT
AIYLCAVDRFNTIANLPGEYDYWGQGTQVTVSS

<118N121_B8_1_OK/1-135, SEQ ID NO: 2314; PRT; ->
EVQLVESGGGLVQDGGSLRLSCAASGQLANFASYAMGWFRQAPGKA
REFVAAIRGSGGSTYIADPARSTYYADFVKGRFTISRDNAKNTVYLQMNSLKPEDTAVYYCACETFN
SISNLPGEYDYWGQGTQVTVSS

<118N121_A2_2_OK/1-124, SEQ ID NO: 2315; PRT; ->
KVQLVESGGGLVQAGGSLRLSCAASGRTFSNYSVGWFRQAPGKEREFVA
ALSKDGARTYYAASVKGRFTIYRDNAKNVVYLQMSVLNGEDTAVYYCAADHFTFMSNLPSEYDYWGQGTQVTVSS

<118N121_A8_2_OK/1-124, SEQ ID NO: 2316; PRT; ->
EVQLVESGGGLVQAGGSLTLSCVISGLTLESHAMGWFRQAPGEEREF
VATIRWSGSATFYSDSVKGRFTISRDNAKNTVYLQMNSLKPEDTAVYYCAARKIYRSLSYYGDYDSWGQGTQVTVSS

<118N121_B3_1_OK/1-123, SEQ ID NO: 2317; PRT; ->
EVQLVESGGGLVQPGGSLRLSCAASGRTFSDLALGWFRRAPGKERE
HVAAISSSGVTTIYADSVRGRFTISRDEAKNTVYLEMNSLKTDDTAVYYCAARLTMATPNQSQYYYWGQGTQVTVSS

<118N121_A5_2_OK/1-114, SEQ ID NO: 2318; PRT; ->
EVQLVESGGGSVQPGGSLRLSCVASGSISSTNAMGWHRQVSGKERE
LVAIVTDGFTNYADFAKGRFTISRDNAKTTVYLQMNSLQPEDTARYYCRYSGIGTDNWGQGIEVTVSS

<118N121_A9_2_OK/1-114, SEQ ID NO: 2319; PRT; ->
EVQLVESGGGSVQPGGSLRLSCVASGSISSVNAMGWHRQVPGKQRE
LVAIVTDGFTNYADFAKGRFTISRDNAKTTVYLQMNSLQPEDTARYYCRYSGIGTDNWGQGIEVTVSS

<118N121_A7_1_OK/1-122, SEQ ID NO: 2320; PRT; ->
EVQLVESGGGLVQPGGSLRLSCAASGNIKSIDVMGWHRQAPGKERE
LVSDISFGGNTNYANSVKGRFTISRDNAKNTVYLQMNSLKPEDTAVYYCYADILYKTDITYYRNDFWGQGTQVTVSS

TABLE B-3-continued

Nanobodies against HER2 obtained as described in Example 4

<Name, SEQ ID #; PRT (protein); ->

<118N121_A10_1_OK/1-131, SEQ ID NO: 2321; PRT; ->
EVQLVESGGGLVQAGGSLRLSCAASGFSFADYAIGWFRQAPGKEREGVSCIANSE
GTKYYADSAQGRLPISSDNAKKTVYLQMDSLKPEDTAVYYCAALPYTICPVVVKKGAVYYGVDDYWGKGTQVTVSS

<118N121_A11_1_OK/1-120, SEQ ID NO: 2322; PRT; ->
EVQLVESGGGLVQPGGSLRLSCAASGFPFGMYGMRWVRQAPGKGPERVSSINSDG
DTTYYADSVKGRFTISRDNDENMLYLQMNSLKPEDTAVYYCATGFSDRSFAVTHKGQGTQVTVSS

<118N121_B7_4_OK/1-124, SEQ ID NO: 2323; PRT; ->
EVQLVESGGGLEQAGGSLRLSCAASGLTFRSAAMGWFRQGPGKEREFVAAISRDG
AATYYTDSVKGRFTISRDNAKNTVFLQMNSLKPEDTAIYYCAADFRLARLRVADDYDYWGQGTQVTVSS

<118N121_B2_1_OK/1-130, SEQ ID NO: 2324; PRT; ->
EVQLVESGGGLVQAGGSLRLSCAASGFSLDDRAIAWFRQAPGKAREGVSCITPHH
GGIIFTRESVKGRFATSSDSAKNTVYLQMHSLKPEDTAVYYCATLRTDYSINWANCQRDSLYGYWGQGTQVTVSS

<118N121_B7_1_OK/1-119, SEQ ID NO: 2325; PRT; ->
EMQLVESGGGLVQPGGSLRLSCAASGNIPPINAMAWYRQAPGNERELVAAVTSGG
GTNYATSVKGRFIISRDDSKNTVDLQMNSLKPEDTAVYYCNLGGWTRTHPFDYWGQGTQVTVSS

TABLE B-4

Bivalent Nanobodies against HER2 as described in Example 12

<Name, SEQ ID #; PRT (protein); ->

<2A4-9GS-2A4, SEQ ID NO: 2326; PRT; ->
EVQLVESGGGLVQPGGSLRLSCAASGFIFDDYAMSWVRQAPGKGLEWVSA
INWSGSHRNYADSVKGRFTISRDNAKKTVYLQMNSLQSEDTAVYYCGTGW
QSTTKNQGYWGQGTQVTVSSGGGGSGGGGSEVQLVESGGGLVQPGGSLRLS
CAASGFIFDDYAMSWVRQAPGKGLEWVSAINWSGSHRNYADSVKGRFTIS
RDNAKKTVYLQMNSLQSEDTAVYYCGTGWQSTTKNQGYWGQGTQVTVSS

<2A5-9GS-2A5, SEQ ID NO: 2327; PRT; ->
EVQLVESGGGLVQPGGSLRLSCATSGFTFDDYAMTWVRQAPGKGLEWVSS
INWSGTHTDYTDSVKGRFTISRNNANNTLYLQMNSLKSEDTAVYYCAKNW
GDAGTTWFEKSGSAGQGTQVTVSSGGGGSGGGGSEVQLVESGGGLVQPGGS
LRLSCATSGFTFDDYAMTWVRQAPGKGLEWVSSINWSGTHTDYTDSVKGR
FTISRNNANNTLYLQMNSLKSEDTAVYYCAKNWGDAGTTWFEKSGSAGQG
TQVTVSS

<2C3-9GS-2C3, SEQ ID NO: 2328; PRT; ->
EVQLVESGGGLVQPGGSLRLSCVASGFSLDDYGMTWVRQAPGKGLEWVSS
INWSGTHTDYADSVKGRFTISRDNAKNTLFLQMNSLRSEDTAVYYCNQGW
KIVPTDRTGHGTQVTVSSGGGGSGGGSEVQLVESGGGLVQPGGSLRLSCV
ASGFSLDDYGMTWVRQAPGKGLEWVSSINWSGTHTDYADSVKGRFTISRD
NAKNTLFLQMNSLRSEDTAVYYCNQGWKIVPTDRTGHGTQVTVSS

<2D3-9GS-2D3, SEQ ID NO: 2329; PRT; ->
EVQLVESGGSLVQPGGSLRLSCAASGFTFDDYAMSWVRQVPGKGLEWVSS
INWSGTHTDYADSVKGRFTISRNNANNTLYLQMNSLKSEDTAVYYCAKNW
RDAGTTWFEKSGSAGQGTQVTVSSGGGGSGGGGSEVQLVESGGSLVQPGGS
LRLSCAASGFTFDDYAMSWVRQVPGKGLEWVSSINWSGTHTDYADSVKGR
FTISRNNANNTLYLQMNSLKSEDTAVYYCAKNWRDAGTTWFEKSGSAGQG
TQVTVSS

<5F7-9GS-5F7, SEQ ID NO: 2330; PRT; ->
EVQLVESGGGLVQAGGSLRLSCAASGITFSINTMGWYRQAPGKQRELVAL
ISSIGDTYYADSVKGRFTISRDNAKNTVYLQMNSLKPEDTAVYYCKRFRT
AAQGTDYWGQGTQVTVSSGGGGSGGGSEVQLVESGGGLVQAGGSLRLSCA
ASGITFSINTMGWYRQAPGKQRELVALISSIGDTYYADSVKGRFTISRDN
AKNTVYLQMNSLKPEDTAVYYCKRFRTAAQGTDYWGQGTQVTVSS

TABLE B-5

Bispecific Nanobodies against HER2 and against serum albumin as described in Example 12

<Name, SEQ ID #; PRT (protein); ->

<2C3-9GS-ALB1, SEQ ID NO: 2331; PRT; ->
EVQLVESGGGLVQPGGSLRLSCVASGFSLDDYGMTWVRQAPGKGLEWVSS
INWSGTHTDYADSVKGRFTISRDNAKNTLFLQMNSLRSEDTAVYYCNQGW
KIVPTDRTGHGTQVTVSSGGGGSGGGGSEVQLVESGGGLVQPGGSLRLSCA
ASGFTFRSFGMSWVRQAPGKEPEWVSSISGSGSDTLYADSVKGRFTISRD
NAKTTLYLQMNSLKPEDTAVYYCTIGGSLSRSSQGTQVTVSS

<2A4-9GS-ALB1, SEQ ID NO: 2332; PRT; ->
EVQLVESGGGLVQPGGSLRLSCAASGFIFDDYAMSWVRQAPGKGLEWVSA
INWSGSHRNYADSVKGRFTISRDNAKKTVYLQMNSLQSEDTAVYYCGTGW
QSTTKNQGYWGQGTQVTVSSGGGGSGGGGSEVQLVESGGGLVQPGNSLRLS
CAASGFTFRSFGMSWVRQAPGKEPEWVSSISGSGSDTLYADSVKGRFTIS
RDNAKTTLYLQMNSLKPEDTAVYYCTIGGSLSRSSQGTQVTVSS

<2A5-9GS-ALB1, SEQ ID NO: 2333; PRT; ->
EVQLVESGGGLVQPGGSLRLSCATSGFTFDDYAMTWVRQAPGKGLEWVSS
INWSGTHTDYTDSVKGRFTISRNNANNTLYLQMNSLKSEDTAVYYCAKNW
GDAGTTWFEKSGSAGQGTQVTVSSGGGGSGGGGSEVQLVESGGGLVQPGNS
LRLSCAASGFTFRSFGMSWVRQAPGKEPEWVSSISGSGSDTLYADSVKGR
FTISRDNAKTTLYLQMNSLKPEDTAVYYCTIGGSLSRSSQGTQVTVSS

<2D3-9GS-ALB1, SEQ ID NO: 2334; PRT; ->
EVQLVESGGSLVQPGGSLRLSCAASGFTFDDYAMSWVRQVPGKGLEWVSS
INWSGTHTDYADSVKGRFTISRNNANNTLYLQMNSLKSEDTAVYYCAKNW
RDAGTTWFEKSGSAGQGTQVTVSSGGGGSGGGGSEVQLVESGGGLVQPGNS
LRLSCAASGFTFRSFGMSWVRQAPGKEPEWVSSISGSGSDTLYADSVKGR
FTISRDNAKTTLYLQMNSLKPEDTAVYYCTIGGSLSRSSQGTQVTVSS

<5F7-9GS-ALB1, SEQ ID NO: 2335; PRT; ->
EVQLVESGGGLVQAGGSLRLSCAASGITFSINTMGWYRQAPGKQRELVAL
ISSIGDTYYADSVKGRFTISRDNAKNTVYLQMNSLKPEDTAVYYCKRFRT
AAQGTDYWGQGTQVTVSSGGGGSGGGGSEVQLVESGGGLVQPGNSLRLSCA
ASGFTFRSFGMSWVRQAPGKEPEWVSSISGSGSDTLYADSVKGRFTISRD
NAKTTLYLQMNSLKPEDTAVYYCTIGGSLSRSSQGTQVTVSS

TABLE B-6

Biparatopic Nanobodies against HER2

<Name, SEQ ID #; PRT (protein); ->

<27B3-35GS-2D3, SEQ ID NO: 2336; PRT; ->
EVQLVESGGGLVQAGGSLTLSCTASETTVRIRTMAWYRQPPGNQREWVATIGSNGFATYPDSVKGRFTISRDN
AKNTVYLQMNSLKPEDTAVYYCRDINRDIWGQGSQVTVSSGGGGSGGGGSGGGGSGGGGSGGGGSGGGGSGGG
GSEVQLVESGGSLVQPGGSLRLSCAASGFTFDDYAMSWVRQVPGKGLEWVSSINWSGTHTDYADSVKGRFTIS
RNNANNTLYLQMNSLKSEDTAVYYCAKNWRDAGTTWFEKSGSAGQGTQVTVSS

<27C3-35GS-2D3, SEQ ID NO: 2337; PRT; ->
EVQLVESGGGLVQPGGSLRLSCAASGFTFDDYATSWVRQAPGKGPEWVSAINSGGGSTYYADSVKGRFTISRD
NAKNTLYLQMNSLKPEDTAVYYCARPRGSSLYLLEYDYWGQGTQVTVSSGGGGSGGGGSGGGGSGGGGSGGGG
SGGGGSGGGGSEVQLVESGGSLVQPGGSLRLSCAASGFTFDDYAMSWVRQVPGKGLEWVSSINWSGTHTDYAD
SVKGRFTISRNNANNTLYLQMNSLKSEDTAVYYCAKNWRDAGTTWFEKSGSAGQGTQVTVSS

<27E5-35GS-2D3, SEQ ID NO: 2338; PRT; ->
EVQLVESGGGLVQAGGSLTLSCTASETTVRIRTMAWYRQPPGNQREWVATIGSNGFATYPDSVKGRFTISRDN
AKNTVYLQMNSLKPEDTAVYYCRDINRDIWGQGSQVTVSSGGGGSGGGGSGGGGSGGGGSGGGGSGGGGSGGG
GSEVQLVESGGSLVQPGGSLRLSCAASGFTFDDYAMSWVRQVPGKGLEWVSSINWSGTHTDYADSVKGRFTIS
RNNANNTLYLQMNSLKSEDTAVYYCAKNWRDAGTTWFEKSGSAGQGTQVTVSS

<27F2-35GS-2D3, SEQ ID NO: 2339; PRT; ->
EVQLVESGGGLVQAGGSLRLSCAASGIISSFRTLAWYRQAPGKQRDWVATISSAGGTAYADAVKGRFTISISRD
NVEYTVDLQMDSLKPEDTAVYYCRDINGDYWGQGTQVTVSSGGGGSGGGGSGGGGSGGGGSGGGGSGGGGSGGG
GSEVQLVESGGSLVQPGGSLRLSCAASGFTFDDYAMSWVRQVPGKGLEWVSSINWSGTHTDYADSVKGRFTISR
NNANNTLYLQMNSLKSEDTAVYYCAKNWRDAGTTWFEKSGSAGQGTQVTVSS

<27D6-35GS-2D3, SEQ ID NO: 2340; PRT; ->
EVQLVESGGGLVQAGGSLTLSCTASETTVRIRTMAWYRQPPGNQREWVATIGSNGFATYPDSVKGRFTISRDNA
KNTVYLQMNSLKPEDTAVYYCRDINRDIWGQGSQVTVSSGGGGSGGGGSGGGGSGGGGSGGGGSGGGGSGGGGS
EVQLVESGGSLVQPGGSLRLSCAASGFTFDDYAMSWVRQVPGKGLEWVSSINWSGTHTDYADSVKGRFTISRNN
ANNTLYLQMNSLKSEDTAVYYCAKNWRDAGTTWFEKSGSAGQGTQVTVSS

<30D10-35GS-2D3, SEQ ID NO: 2341; PRT; ->
EVQLVESGGGLVQAGGSLTLSCTASETTVRIRTMAWYRQPPGNQREWVATIGSNGFATYPDSVKGRFTISRDNA
KNTVYLQMNSLKPEDTAVYYCRDINRDIWGQGSQVTVSSGGGGSGGGGSGGGGSGGGGSGGGGSGGGGSGGGGS
EVQLVESGGSLVQPGGSLRLSCAASGFTFDDYAMSWVRQVPGKGLEWVSSINWSGTHTDYADSVKGRFTISRNN
ANNTLYLQMNSLKSEDTAVYYCAKNWRDAGTTWFEKSGSAGQGTQVTVSS

<47D5-35GS-2D3, SEQ ID NO: 2342; PRT; ->
KVQLVESGGGLVQPGGSLRLSCAASGSIFGFNDMAWYRQAPGKQRELVALISRVGVTSSADSVKGRFTISRVNA
KDTVYLQMNSLKPEDTAVYYCYMDQRLDGSTLAYWGQGTQVTVSSGGGGSGGGGSGGGGSGGGGSGGGGSGGGG
SGGGGSEVQLVESGGSLVQPGGSLRLSCAASGFTFDDYAMSWVRQVPGKGLEWVSSINWSGTHTDYADSVKGRF
TISRNNANNTLYLQMNSLKSEDTAVYYCAKNWRDAGTTWFEKSGSAGQGTQVTVSS

<DUMMY-35GS-2D3, SEQ ID NO: 2343; PRT; ->
EVQLVESGGGLVQAGGSLRLSCAASGRTFRSYPMGWFRQAPGKEREFVASITGSGGSTYYADSVKGRFTISRDN
AKNTVYLQMNSLRPEDTAVYSCAAYIRPDTYLSRDYRKYDYWGQGTQVTVSSGGGGSGGGGSGGGGSGGGGSGG
GGSGGGGSGGGGSEVQLVESGGSLVQPGGSLRLSCAASGFTFDDYAMSWVRQVPGKGLEWVSSINWSGTHTDYA
DSVNGRFTISRNNANNTLYLQMNSLKSEDTAVYYCAKNWRDAGTTWFEKSGSAGQGTQVTVSS

<2D3-35GS-2D3, SEQ ID NO: 2344; PRT; ->
EVQLVESGGSLVQPGGSLRLSCAASGFTFDDYAMSWVRQVPGKGLEWVSSINWSGTHTDYADSVKGRFTISRNN
ANNTLYLQMNSLKSEDTAVYYCAKNWRDAGTTWFEKSGSAGQGTQVTVSSGGGGSGGGGSGGGGSGGGGSGGGG
SGGGGSGGGGSEVQLVESGGSLVQPGGSLRLSCAASGFTFDDYAMSWVRQVPGKGLEWVSSINWSGTHTDYADS
VKGRFTISRNNANNTLYLQMNSLKSEDTAVYYCAKNWRDAGTTWFEKSGSAGQGTQVTVSS

<DUMMY-35GS-47D5, SEQ ID NO: 2345; PRT; ->
EVQLVESGGGLVQAGGSLRLSCAASGRTFRSYPMGWFRQAPGKEREFVASITGSGGSTYYADSVKGRFTISRDN
AKNTVYLQMNSLRPEDTAVYSCAAYIRPDTYLSRDYRKYDYWGQGTQVTVSSGGGGSGGGGSGGGGSGGGGSGG
GGSGGGGSGGGGSEVQLVESGGGLVQPGGSLRLSCAASGSIFGFNDMAWYRQAPGKQRELVALISRVGVTSSAD
SVKGRFTISRVNAKDTVYLQMNSLKPEDTAVYYCYMDQRLDGSTLAYWGQGTQVTVSS

<5F7-35GS-47D5, SEQ ID NO: 2346; PRT; ->
EVQLVESGGGLVQAGGSLRLSCAASGITFSINTMGWYRQAPGKQRELVALISSIGDTYYADSVKGRFTISRDNA
KNTVYLQMNSLKPEDTAVYYCKRFRTAAQGTDYWGQGTQVTVSSGGGGSGGGGSGGGGSGGGGSGGGGSGGGGS
GGGGSEVQLVESGGGLVQPGGSLRLSCAASGSIFGFNDMAWYRQAPGKQRELVALISRVGVTSSADSVKGRFTI
SRVNAKDTVYLQMNSLKPEDTAVYYCYMDQRLDGSTLAYWGQGTQVTVSS

<47D5-35GS-5F7, SEQ ID NO: 2347; PRT; ->
KVQLVESGGGLVQPGGSLRLSCAASGSIFGFNDMAWYRQAPGKQRELVALISRVGVTSSADSVKGRFTISRVNA
KDTVYLQMNSLKPEDTAVYYCYMDQRLDGSTLAYWGQGTQVTVSSGGGGSGGGGSGGGGSGGGGSGGGGSGGGG
SGGGGSEVQLVESGGGLVQAGGSLRLSCAASGITFSINTMGWYRQAPGKQRELVALISSIGDTYYADSVKGRFT
ISRDNAKNTVYLQMNSLKPEDTAVYYCKRFRTAAQGTDYWGQGTQVTVSS

<2D3-35GS-47D5, SEQ ID NO: 2348; PRT; ->
EVQLVESGGSLVQPGGSLRLSCAASGFTFDDYAMSWVRQVPGKGLEWVSSINWSGTHTDYADSVKGRFTISRNN
ANNTLYLQMNSLKSEDTAVYYCAKNWRDAGTTWFEKSGSAGQGTQVTVSSGGGGSGGGGSGGGGSGGGGSGGGG

TABLE B-6-continued

Biparatopic Nanobodies against HER2

<Name, SEQ ID #; PRT (protein); ->

SGGGGSGGGGSEVQLVESGGGLVQPGGSLRLSCAASGSIFGFNDMAWYRQAPGKQRELVALISRVGVTSSADSV
KGRFTISRVNAKDTVYLQMNSLKPEDTAVYYCYMDQRLDGSTLAYWGQGTQVTVSS

<27F7-35GS-2D3, SEQ ID NO: 2349; PRT; ->
EVQLVESGGGLVQAGGSLRLSCVVSGIPSTIRAMAWYRQAPGRQRDWVATIYSPSGSAVYADSVKGRFTISSDN
AKKTIYLQMNSLKPDDTAVYYCRDVNREYWGQGTQVTVSSGGGGSGGGGSGGGGSGGGGSGGGGSGGGGSGGGG
SEVQLVESGGSLVQPGGSLRLSCAASGFTFDDYAMSWVRQVPGKGLEWVSSINWSGTHTDYADSVKGRFTISRN
NANNTLYLQMNSLKSEDTAVYYCAKNWRDAGTTWFEKSGSAGQGTQVTVSS

<28F6-35GS-2D3, SEQ ID NO: 2350; PRT; ->
EVQLVESGGGLVQAGGSLNLSCVASGIPFSTRTMAWYRQPPGNERDWVATIRSGAPVYADSVKGRFTVSRDNAK
NTLYLQMNSLEPEDTATYYCWDVNGDIWGQGTPVTVSSGGGGSGGGGSGGGGSGGGGSGGGGSGGGGSGGGGSE
VQLVESGGSLVQPGGSLRLSCAASGFTFDDYAMSWVRQVPGKGLEWVSSINWSGTHTDYADSVKGRFTISRNNA
NNTLYLQMNSLKSEDTAVYYCAKNWRDAGTTWFEKSGSAGQGTQVTVSS

<28G3-35GS-2D3, SEQ ID NO: 2351; PRT; ->
EVQLVESGGGLVQAGGSLNLSCVASGIPFSTRTMAWYRQPPGNERDWVATIRSGAPVYADSVKGRFTVSRDNAK
NTLYLQMNSLEPEDTATYYCWDVNGDIWGQGTPVTVSSGGGGSGGGGSGGGGSGGGGSGGGGSGGGGSGGGGSE
VQLVESGGSLVQPGGSLRLSCAASGFTFDDYAMSWVRQVPGKGLEWVSSINWSGTHTDYADSVKGRFTISRNNA
NNTLYLQMNSLKSEDTAVYYCAKNWRDAGTTWFEKSGSAGQGTQVTVSS

<28G5-35GS-2D3, SEQ ID NO: 2352; PRT; ->
EVQLVESGGGLVQAGGSLRLSCVTSRRPASTRTMAWYRQAPGKQRDWVATISSHGLPVYADSVKGRFTVSRDNA
NNTVYLQMNTLKPEDTAVYYCRDVNADYWGQGTQVTVSSGGGGSGGGGSGGGGSGSGGSGGGGSGGGGSGGGGS
EVQLVESGGSLVQPGGSLRLSCAASGFTFDDYAMSWVRQVPGKGLEWVSSINWSGTHTDYADSVKGRFTISRNN
ANNTLYLQMNSLKSEDTAVYYCAKNWRDAGTTWFEKSGSAGQGTQVTVSS

<29D9-35GS-2D3, SEQ ID NO: 2353; PRT; ->
EVQLVESGGGLVQPGGSLRLSCAASRIPFSTRTMAWYRQAPGKQRDWVATIGTSGPPRYADSVKGRFTVSRDNA
KNTVYLQMNSLKAEDTAVYYCWDVNADYWGQGTQVTVSSGGGGSGGGGSGGGGSGGGGSGGGGSGGGGSGGGGS
EVQLVESGGSLVQPGGSLRLSCAASGFTFDDYAMSWVRQVPGKGLEWVSSINWSGTHTDYADSVKGRFTISRNN
ANNTLYLQMNSLKSEDTAVYYCAKNWRDAGTTWFEKSGSAGQGTQVTVSS

<29E9-35GS-2D3, SEQ ID NO: 2354; PRT; ->
EVQLVESGGGLVQPGGSLRLSCVASRIPASIRTMAWYRQTPGNQRDWLATIGSSGTPAYADSVKGRFTVSRDNA
KNTVYLQMNSLKPEDTAVYYCRDVNGDYWGQGTQVTVSSGGGGSGGGGSGGGGSGGGGSGGGGSGGGGSGGGGS
EVQLVESGGSLVQPGGSLRLSCAASGFTFDDYAMSWVRQVPGKGLEWVSSINWSGTHTDYADSVKGRFTISRNN
ANNTLYLQMNSLKSEDTAVYYCAKNWRDAGTTWFEKSGSAGQGTQVTVSS

<30E10-35GS-2D3, SEQ ID NO: 2355; PRT; ->
KVQLVESGGSLVPPGGSLRLSCAASGFTFDDYAMTWVRQAPGKGLEWVSSINWSGTHTDYTDSVKGRFTISRNN
ANNTLYLQMNSLKSEDTAVYYCAKNWGDAGTTWFEKSGSAGQGTQVTVSSGGGGSGGGGSGGGGSGGGGSGGGG
SGGGGSGGGGSEVQLVESGGSLVQPGGSLRLSCAASGFTFDDYAMSWVRQVPGKGLEWVSSINWSGTHTDYADS
VKGRFTISRNNANNTLYLQMNSLKSEDTAVYYCAKNWRDAGTTWFEKSGSAGQGTQVTVSS

<31D11-35GS-2D3, SEQ ID NO: 2356; PRT; ->
EVQLVESGGGLVQAGGSLNLSCVASGIPFSTRTMAWYRQPPGNERDWVATIRSGAPVYADSVKGRFTVSRDNAK
NTLYLQMNSLEPEDTATYYCWDVNGDIWGQGTPVTVSSGGGGSGGGGSGGGGSGGGGSGGGGSGGGSGSGGGGSE
VQLVESGGSLVQPGGSLRLSCAASGFTFDDYAMSWVRQVPGKGLEWVSSINWSGTHTDYADSVKGRFTISRNNA
NNTLYLQMNSLKSEDTAVYYCAKNWRDAGTTWFEKSGSAGQGTQVTVSS

<27G2-35GS-2D3, SEQ ID NO: 2357; PRT; ->
EVQLVESGGSLVQPGGSLRLSCAASGFTFDDYAMTWVRQTPGKGLEWVSSINWSGTHTDYTDSVKGRFTISRNN
ANNTLYLQMNSLKSDDTAVYYCAKNWGDAGTTWFEKSGSAGPGTQVTVSSGGGGSGGGGSGGGGSGGGGSGGGG
SGGGGSGGGGSEVQLVESGGSLVQPGGSLRLSCAASGFTFDDYAMSWVRQVPGKGLEWVSSINWSGTHTDYADS
VKGRFTISRNNANNTLYLQMNSLKSEDTAVYYCAKNWRDAGTTWFEKSGSAGQGTQVTVSS

<P27G4-35GS-2D3, SEQ ID NO: 2358; PRT; ->
EVQLVESGGGLVQAGGSLRLSCVTSRRPASTRTMAWYRQAPGKQRDWVATISSHGLPVYADSVKGRFTVSRDNA
NNTVYLQMNTLKPEDTAVYYCRDVNADYWGQGTQVTVSSGGGGSGGGGSGGGGSGGGGSGGGGSGGGGSGGGGS
EVQLVESGGSLVQPGGSLRLSCAASGFTFDDYAMSWVRQVPGKGLEWVSSINWSGTHTDYADSVKGRFTISRNN
ANNTLYLQMNSLKSEDTAVYYCAKNWRDAGTTWFEKSGSAGQGTQVTVSS

<27G5-35GS-2D3, SEQ ID NO: 2359; PRT; ->
EVQLVESGGGLVQPGGSLRLSCVASRIPASIRTMAWYRQTPGNQRDWLATIGSSGTPAYADSVKGRFTVSRDNA
KNTVYLQMNSLKPEDTAVYYCRDVNGDYWGQGTQVTVSSGGGGSGGGGSGGGGSGGGGSGGGGSGGGGSGGGGS
EVQLVESGGSLVQPGGSLRLSCAASGFTFDDYAMSWVRQVPGKGLEWVSSINWSGTHTDYADSVKGRFTISRNN
ANNTLYLQMNSLKSEDTAVYYCAKNWRDAGTTWFEKSGSAGQGTQVTVSS

<27G7-35GS-2D3, SEQ ID NO: 2360; PRT; ->
EVQLVESGGGLVQAGGSLRLSCVTSRRPASTRTMAWYRQAPGKQRDWVATISSHGLPVYADSVKGRFTVSRDNA
NNTVYLQMNTLKPEDTAVYYCRDVNADYWGQGTQVTVSSGGGGSGGGGSGGGGSGGGGSGGGGSGGGGSGGGGS
EVQLVESGGSLVQPGGSLRLSCAASGFTFDDYAMSWVRQVPGKGLEWVSSINWSGTHTDYADSVKGRFTISRNN
ANNTLYLQMNSLKSEDTAVYYCAKNWRDAGTTWFEKSGSAGQGTQVTVSS

TABLE B-6-continued

Biparatopic Nanobodies against HER2

<Name, SEQ ID #; PRT (protein); ->

<27H1-35GS-2D3, SEQ ID NO: 2361; PRT; ->
EVQLVESGGGLVQAGGSLRLSCVTSRRPASTRTMAWYRQAPGKQRDWVATISSHGLPVYADSVKGRFTVSRDNA
NNTVYLQMNTLKPEDTAVYYCRDVNADYWGQGTQVTVSSGGGGSGGGGSGGGGSGGGGSGGGGSGGGGSGGGGS
EVQLVESGGSLVQPGGSLRLSCAASGFTFDDYAMSWVRQVPGKGLEWVSSINWSGTHTDYADSVKGRFTISRNN
ANNTLYLQMNSLKSEDTAVYYCAKNWRDAGTTWFEKSGSAGQGTQVTVSS

<27H2-35GS-2D3, SEQ ID NO: 2362; PRT; ->
EVQLVESGGGLVQAGGSLRLSCVTSRRPASTRTMAWYRQAPGKQRDWVATISSHGLPVYADSVKGRFTVSRDNA
NNTVYLQMNTLKPEDTAVYYCRDVNADYWGQGTQVTVSSGGGGSGGGGSGGGGSGGGGSGGGGSGGGGSGGGGS
EVQLVESGGSLVQPGGSLRLSCAASGFTFDDYAMSWVRQVPGKGLEWVSSINWSGTHTDYADSVKGRFTISRNN
ANNTLYLQMNSLKSEDTAVYYCAKNWRDAGTTWFEKSGSAGQGTQVTVSS

<27H3-35GS-2D3, SEQ ID NO: 2363; PRT; ->
EVQLVESGGSLVQPGGSLRLSCAASGFTFDDYAMTWVRQASGKGLEWVSSINWSGTHTDYTDSVKGRFTISRNN
ANNTLYLQMNSLKSEDTAVYYCAKNWGDAGTTWFEKSGSAGQGTQVTVSSGGGGSGGGGSGGGGSGGGGSGGGG
SGGGGSGGGGSEVQLVESGGSLVQPGGSLRLSCAASGFTFDDYAMSWVRQVPGKGLEWVSSINWSGTHTDYADS
VKGRFTISRNNANNTLYLQMNSLKSEDTAVYYCAKNWRDAGTTWFEKSGSAGQGTQVTVSS

<27H4-35GS-2D3, SEQ ID NO: 2364; PRT; ->
EVQLVESGGGLVQAGGSLRLSCVASKMTFMRYTMGWYRQAPGKQRDLVASIDASGGTNYADSVKGRFTISRDNA
KNTVYLEMNSLKPEDTGVYYCNGRWDIVGAIWWGQGTQVTVSSGGGGSGGGGSGGGGSGGGGSGGGGSGGGGSG
GGGSEVQLVESGGSLVQPGGSLRLSCAASGFTFDDYAMSWVRQVPGKGLEWVSSINWSGTHTDYADSVKGRFTI
SRNNANNTLYLQMNSLKSEDTAVYYCAKNWRDAGTTWFEKSGSAGQGTQVTVSS

<27H5-35GS-2D3, SEQ ID NO: 2365; PRT; ->
EVQLVESGGGLVQAGGSLRLSCAASGFTFDDYGIGWFRQASGKEREGVSCITSSDGSTYYADSVKGRFTISSDN
AKNTVYLQMNSLKPEDTAVYYCAALPFVCPSGSYSDYGDEYDYWGQGTQVTVSSGGGGSGGGGSGGGGSGGGGS
GGGGSGGGGSGGGGSEVQLNESGGSLVQPGGSLRLSCAASGFTFDDYAMSWVRQVPGKGLEWVSSINWSGTHTD
YADSVKGRFTISRNNANNTLYLQMNSLKSEDTAVYYCAKNWRDACTTWFEKSGSAGQGTQVTVSS

<27H7-35GS-2D3, SEQ ID NO: 2366; PRT; ->
EVQLVESGGGLVQAGGSLRLSCAASGIAFRIRTMAWYRQAPGKQRDWVATSDSGGTTLYADSVKGRFTVSRDNA
ENTVYLQMNSLKPEDTAVYYCRDVNRDYWGQGTQVTVSSGGGGSGGGGSGGGGSGGGGSGGGGSGGGGSGGGGS
EVQLVESGGSLVQPGGSLRLSCAASGFTFDDYAMSWVRQVPGKGLEWVSSINWSGTHTDYADSVKGRFTISRNN
ANNTLYLQMNSLKSEDTAVYYCAKNWRDAGTTWFEKSGSAGQGTQVTVSS

<27A3-35GS-2D3, SEQ ID NO: 2367; PRT; ->
EVQLVESGGGLVQAGGSLSLSCVASGRFFSTRVMAWYRQTPGKQREFVASMRGSGSTNYADSVRGRFAISRDNA
KNTVYLQMNTLKPEDTAVYYCRDINEDQWGQGTQVTVSSGGGGSGGGGSGGGGSGGGGSGGGGSGGGGSGGGGS
EVQLVESGGSLVQPGGSLRLSCAASGFTFDDYAMSWVRQVPGKGLEWVSSINWSGTHTDYADSVKGRFTISRNN
ANNTLYLQMNSLKSEDTAVYYCAKNWRDAGTTWFEKSGSAGQGTQVTVSS

<27A4-35GS-2D3, SEQ ID NO: 2368; PRT; ->
EVQLVESGGGLVQAGGSLRLSCVTSRRPASTRTMAWYRQAPGKQRDWVATISSHGLPVYADSVKGRFTVSRDNA
NNTVYLQMNTLKPEDTAVYYCRDVNADYWGQGTQVTVSSGGGGSGGGGSGGGGSGGGGSGGGGSGGGGSGGGGS
EVQLVESGGSLVQPGGSLRLSCAASGFTFDDYAMSWVRQVPGKGLEWVSSINWSGTHTDYADSVKGRFTISRNN
ANNTLYLQMNSLKSEDTAVYYCAKNWRDAGTTWFEKSGSAGQGTQVTVSS

<27A5-35GS-2D3, SEQ ID NO: 2369; PRT; ->
EVQLVESGGGLVQAGGSLNLSCVASGIPFSTRTMAWYRQPPGNERDWVATIRSGAPVYADSVKGRFTVSRDNAK
NTLYLQMNSLEPEDTATYYCWDVNGDIWGQGTPVTVSSGGGGSGGGGSGGGGSGGGGSGGGGSGGGGSGGGGSE
VQLVESGGSLVQPGGSLRLSCAASGFTFDDYAMSWVRQVPGKGLEWVSSINWSGTHTDYADSVKGRFTISRNNA
NNTLYLQMNSLKSEDTAVYYCAKNWRDAGTTWFEKSGSAGQGTQVTVSS

<27B1-35GS-2D3, SEQ ID NO: 2370; PRT; ->
EVQLVESGGSLVQPGGSLRLSCAASGFTFDDYAMSWVRQAPGKGLEWISSINWSGTHTDYADSVKGRFTISRNN
ANNTLYLQMNNLKFEDTAVYYCAKNWRDAGTTWFEKSGSAGQGTQVTVSSGGGGSGGGGSGGGGSGGGGSGGGG
SGGGGSGGGGSEVQLVESGGSLVQPGGSLRLSCAASGFTFDDYAMSWVRQVPGKGLEWVSSINWSGTHTDYADS
VKGRFTISRNNANNTLYLQMNSLKSEDTAVYYCAKNWRDAGTTWFEKSGSAGQGTQVTVSS

<27B2-35GS-2D3, SEQ ID NO: 2371; PRT; ->
EVQLVESGGGLVQAGGSLRLSCVASGIPSIRAIAWYRQAPGKQRDWVATSGTGYGATYDDSVKGRFTLSRDNAK
NTVYLQMNSLKPEDTAVYCRDVNRDYWGQGTQVTVSSGGGGSGGGGSGGGGSGGGGSGGGGSGGGGSGGGGSE
VQLVESGGSLVQPGGSLRLSCAASGFTFDDYAMSWVRQVPGKGLEWVSSINWSGTHTDYADSVKGRFTISRNNA
NNTLYLQMNSLKSEDTAVYYCAKNWRDAGTTWFEKSGSAGQGTQVTVSS

<27B5-35GS-2D3, SEQ ID NO: 2372; PRT; ->
EVQLVESGGGLVQAGGSLRLPCAASGIAFRIRTMAWYRQAPGKQRDWVATSDSGGTTLYADSVKGRFTVSRDNA
ENTVYLQMNSLKPEDTAVYYCRDVNRDYWGQGTQVTVSSGGGGSGGGGSGGGGSGGGGSGGGGSGGGGSGGGGS
EVQLVESGGSLVQPGGSLRLSCAASGFTFDDYAMSWVRQVPGKGLEWVSSINWSGTHTDYADSVKGRFTISRNN
ANNTLYLQMNSLKSEDTAVYYCAKNWRDAGTTWFEKSGSAGQGTQVTVSS

<27B7-35GS-2D3, SEQ ID NO: 2373; PRT; ->
EVQLVESGGGLVQPGGSLRLSCAASGFTFSSYAMSWVRQAPGKGLEWVSAISSGGGSITTYADSVKGRFTISRD
NAKNTLYLQMSSLKPEDTALYYCAKARSSSSYYDFGSWGQGTQVTVSSGGGGSGGGGSGGGGSGGGGSGGGGSG

TABLE B-6-continued

Biparatopic Nanobodies against HER2

<Name, SEQ ID #; PRT (protein); ->

GGGSGGGGSEVQLVESGGSLVQPGGSLRLSCAASGFTFDDYAMSWVRQVPGKGLEWVSSINWSGTHTDYADSVK
GRFTISRNNANNTLYLQMNSLKSEDTAVYYCAKNWRDAGTTWFEKSGSAGQGTQVTVSS

<27C2-35GS-2D3, SEQ ID NO: 2374; PRT; ->
EVQLVESGGSLVQPGGSLRLSCAASGFTFDDYAMTWVRQASGKGLEWVSSINWSGTHTDYTDSVKGRFTISRNN
ANNTLYLQMNSLKSEDTAVYYCAKNWGDAGTTWFEKSGSAGQGTQVTVSSGGGGSGGGGSGGGGSGGGGSGGGG
SGGGGSGGGGSEVQLVESGGSLVQPGGSLRLSCAASGFTFDDYAMSWVRQVPGKGLEWVSSINWSGTHTDYADS
VKGRFTISRNNANNTLYLQMNSLKSEDTAVYYCAKNWRDAGTTWFEKSGSAGQGTQVTVSS

<27C5-35GS-2D3, SEQ ID NO: 2375; PRT; ->
EVQLVESGGGLVQAGGSLNLSCVASGIPFSTRTMAWYRQPPGNERDWVATIRSGAPVYADSVKGRFTVSRDNAK
NTLYLQMNSLEPEDTATYYCWDVNGDIWGQGTPVTVSSGGGGSGGGGSGGGGSGGGGSGGGGSGGGGSGGGGSE
VQLVESGGSLVQPGGSLRLSCAASGFTFDDYAMSWVRQVPGKGLEWVSSINWSGTHTDYADSVKGRFTISRNNA
NNTLYLQMNSLKSEDTAVYYCAKNWRDAGTTWFEKSGSAGQGTQVTVSS

<27C7-35GS-2D3, SEQ ID NO: 2376; PRT; ->
EVQLVESGGGLVQAGGSLRLSCAASGIAFRIRTMAWYRQAPGKQRDWVATSDSGGTTLYADSVKGRFTVSRDNA
DNTVYLQMNSLKPEDTAVYYCRDVNRDYWGQGTQVTVSSGGGGSGGGGSGGGGSGGGGSGGGGSGGGGSGGGGS
EVQLVESGGSLVQPGGSLRLSCAASGFTFDDYAMSWVRQVPGKGLEWVSSINWSGTHTDYADSVKGRFTISRNN
ANNTLYLQMNSLKSEDTAVYYCAKNWRDAGTTWFEKSGSAGQGTQVTVSS

<27D1-35GS-2D3, SEQ ID NO: 2377; PRT; ->
EVQLVESGGGLVQPGGSLRLSCVASGFSLDDYGMTWVRQAPGKGLEWVSSINWSGTHTDYADSVKGRFTISRDN
AKNTLFLQMNSLTPEDTAVYYCNQGWKILPAERRGHGTQTVSSGGGGSGGGGSGGGGSGGGGSGGGGSGGGGS
GGGGSEVQLVESGGSLVQPGGSLRLSCAASGFTFDDYAMSWVRQVPGKGLEWVSSINWSGIHTDYADSVKGRFT
ISRNNANNTLYLQMNSLKSEDTAVYYCAKNWRDAGTTWFEKSGSAGQGTQVTVSS

<27D2-35GS-2D3, SEQ ID NO: 2378; PRT; ->
EVQLVESGGGLVQPGGSLRLSCAASGLGIAFSRRTMAWYRQAPGKQRDWVATIAGDGSTVYADSMKGRFTISRD
NAKNTVYLQVNSLKPEDTAVYYCWDTNGDYWGQGTQVTVSSGGGGSGGGGSGGGGSGGGGSGGGGSGGGGSGGG
GSEVQLVESGGSLVQPGGSLRLSCAASGFTFDDYAMSWVRQVPGKGLEWVSSINWSGTHTDYADSVKGRFTISR
NNANNTLYLQMNSLKSEDTAVYYCAKNWRDAGTTWFEKSGSAGQGTQVTVSS

<27D3-35GS-2D3, SEQ ID NO: 2379; PRT; ->
EVQLMESGGGLVQFGGSLRLSCAASGLGIAFSRRTMAWYRQAPGKQRDWVATIAGDGSTVYADSMKGRFTISRD
NAENTVYLQMNSLKPEDTAVYYCWDVNRDYWGQGTQVTVSSGGGGSGGGGSGGGGSGGGGSGGGGSGGGGSGGG
GSEVQLVESGGSLVQPGGSLRLSCAASGFTFDDYAMSWVRQVPGKGLEWVSSINWSGTHTDYADSVKGRFTISR
NNANNTLYLQMNSLKSEDTAVYYCAKNWRDAGTTWFEKSGSAGQGTQVTVSS

<27D4-35GS-2D3, SEQ ID NO: 2380; PRT; ->
EVQLVESGGSLVQPGGSLRLSCAASGFTFDDYAMTWVRQASGKGLEWVSSINWSGTHTDYADSVKGRFTISRNN
ANNTLYLQMNSLKSEDTAVYYCAKNWGDAGTTWFEKSGSAGQGTQVTVSSGGGGSGGGGSGGGGSGGGGSGGGG
SGGGGSGGGGSEVQLVESGGSLVQPGGSLRLSCAASGFTFDDYAMSWVRQVPGKGLEWVSSINWSGTHTDYADS
VKGRFTISRNNANNTLYLQMNSLKSEDTAVYYCAKNWRDAGTTWFEKSGSAGQGTQVTVSS

<27D7-35GS-2D3, SEQ ID NO: 2381; PRT; ->
EVQLVESGGGLVQPGGSLRLSCVASGFSLDDYGMTWVRQAPGKGLEWVSSINWSGTHTDYADSVKGRFTISRDN
AKNTLFLQMNSLSPEDTAVYYCNQGWKILPTNRGSHGTQVTVSSGGGGSGGGGSGGGGSGGGGSGGGGSGGGGS
GGGGSEVQLVESGGSLVQPGGSLRLSCAASGFTFDDYAMSWVRQVPGKGLEWVSSINWSGTHTDYADSVKGRFT
ISRNNANNTLYLQMNSLKSEDTAVYYCAKNWRDAGTTWFEKSGSAGQGTQVTVSS

<27E2-35GS-2D3, SEQ ID NO: 2382; PRT; ->
EVQLVESGGGLVQPGGSLRLSCVASGFSLDDYGMTWVRQAPGKGLEWVSSINWSGTHTDYADSVKGRFTISRDN
AKNTLFLQMNSLTPEDTAVYYCNQGWKIIPTDRRGHGTQVTVSSGGGGSGGGGSGGGGSGGGGSGGGGSGGGGS
GGGGSEVQLVESGGSLVQPGGSLRLSCAASGFTFDDYAMSWVRQVPGKGLEWVSSINWSGTHTDYADSVKGRFT
ISRNNANNTLYLQMNSLKSEDTAVYYCAKNWRDAGTTWFEKSGSAGQGTQVTVSS

<27E4-35GS-2D3, SEQ ID NO: 2383; PRT; ->
EVQLVESGGGLVQAGGSLRLSCAASGSTFSINRMAWYRQSPGKQRELVAAVDNDDNTEYSDSVAGRFTISRDNA
KNAVHLQMNSLRLEDTAVYYCNAKQLPYLQNFWGQGTQVTVSSGGGGSGGGGSGGGGSGGGGSGGGGSGGGGSG
GGGSEVQLVESGGSLVQPGGSLRLSCAASGFTFDDYAMSWVRQVPGKGLEWVSSINWSGTHTDYADSVKGRFTI
SRNNANNTLYLQMNSLKSEDTAVYYCAKNWRDAGTTWFEKSGSAGQGTQVTVSS

<27E7-35GS-2D3, SEQ ID NO: 2384; PRT; ->
EVQLVESGGGLVQAGGSLRLSCAASGITFRRYDMGWYRQFPGKERELVATILSEGDTNYVDPVKGRFTISRDNA
KNTVYLQMNDLKPEDTAVYYCNGVWRAIGRTYWGQGTQVTVSSGGGGSGGGGSGGGGSGGGGSGGGGSGGGGSG
GGGSEVQLVESGGSLVQPGGSLRLSCAASGFTFDDYAMSWVRQVPGKGLEWVSSINWSGTHTDYADSVKGRFTI
SRNNANNTLYLQMNSLKSEDTAVYYCAKNWRDAGTTWFEKSGSAGQGTQVTVSS

<29H1-35GS-2D3, SEQ ID NO: 2385; PRT; ->
EVQLVESGGSLVPPGGSLRLSCAASGFTFDDYAMSWVRQAPGKGLEWVSSINWSGTHTGYTDSVKGRFTISRNN
ANNTLYLQMNSLKSEDTAVYYCAKNWGDAGTTWFEKSGSAGQGTQVTVSSGGGGSGGGGSGGGGSGGGGSGGGG
SGGGGSGGGGSEVQLVESGGSLVQPGGSLRLSCAASGFTFDDYAMSWVRQVPGKGLEWVSSINWSGTHTDYADS
VKGRFTISRNNANNTLYLQMNSLKSEDTAVYYCAKNWRDAGTTWFEKSGSAGQGTQVTVSS

TABLE B-6-continued

Biparatopic Nanobodies against HER2

<Name, SEQ ID #; PRT (protein); ->

<30H9-35GS-2D3, SEQ ID NO: 2386; PRT; ->
EVQLVESGGSLVQPGGSLRLSCAASGFTFDDYAMTWVRQAPGKGLEWVSSINWSGTHTDYTDSVKGRFTISRNN
ANNTLYLQMNSLKSEDTAVYYCAKNWGDAGTTWFEKSGSAGQGTQVTVSSGGGGSGGGGSGGGGSGGGGSGGGG
SGGGGSGGGGSEVQLVESGGSLVQPGGSLRLSCAASGFTFDDYAMSWVRQVPGKGLEWVSSINWSGTHTDYADS
VKGRFTISRNNANNTLYLQMNSLKSEDTAVYYCAKNWRDAGTTWFEKSGSAGQGTQVTVSS

<39C1-35GS-2D3, SEQ ID NO: 2387; PRT; ->
EVQLVESGGSLVPPGGSLRLSCAASGFTFDDYGMSWVRQAPGKGLEWVSSINWSGTHTDYTDSVKGRFTISRNN
ANNTLYLQMNSLKSEDTAVYYCAKNWGDAGTTWFEKSGSAGQGTQVTVSSGGGGSGGGGSGGGGSGGGGSGGGG
SGGGGSGGGGSEVQLVESGGSLVQPGGSLRLSCAASGFTFDDYAMSWVRQVPGKGLEWVSSINWSGTHTDYADS
VKGRFTISRNNANNTLYLQMNSLKSEDTAVYYCAKNWRDAGTTWFEKSGSAGQGTQVTVSS

<27G8-35GS-2D3, SEQ ID NO: 2388; PRT; ->
EVQLVESGGGLVQPGGSLRLSCVASGFSLDDYGMTWVRQAPGKGLEWVSSINWSGTHTDYADSVKGRFTISRDN
AKNTLFLQMNSLTPEDTAVYYCNQGWKILPAERRGHGTQVTVSSGGGGSGGGGSGGGGSGGGGSGGGGSGGGGS
GGGGSEVQLVESGGSLVQPGGSLRLSCAASGFTFDDYAMSWVRQVPGKGLEWVSSINWSGTHTDYADSVKGRFT
ISRNNANNTLYLQMNSLKSEDTAVYYCAKNWRDAGTTWFEKSGSAGQGTQVTVSS

<29H2-35GS-2D3, SEQ ID NO: 2389; PRT; ->
EVQLVESGGGLVQPGGSLRLSCVASGFSLDDYGMTWVRQAPGKGLEWVSSINWSGTHTDYADSVKGRFTISRDN
AKNTLFLQMNNLTPEDTAVYYCNQGWKIIPTDRRGHGTQVTVSSGGGGSGGGGSGGGGSGGGGSGGGGSGGGGS
GGGGSEVQLVESGGSLVQPGGSLRLSCAASGFTFDDYAMSWVRQVPGKGLEWVSSINWSGTHTDYADSVKGRFT
ISRNNANNTLYLQMNSLKSEDTAVYYCAKNWRDAGTTWFEKSGSAGQGTQVTVSS

<38C6-35GS-2D3, SEQ ID NO: 2390; PRT; ->
EVQLVESGGGLVQPGGSLRLSCVGSGFSLDDYAMTWVRQAPGKGLEWVSSINWSGTHTDYADSVKGRFTISRDN
AKNTLFLQMNSLSPEDTAVYYCNQGWKIRPTIPMGHGTQVTVSSGGGGSGGGGSGGGGSGGGGSGGGGSGGGGS
GGGGSEVQLVESGGSLVQPGGSLRLSCAASGFTFDDYAMSWVRQVPGKGLEWVSSINWSGTHTDYADSVKGRFT
ISRNNANNTLYLQMNSLKSEDTAVYYCAKNWRDAGTTWFEKSGSAGQGTQVTVSS

TABLE C-1

Sequence of HER2 binding Nanobodies aligned by family

HERCEPTIN® COMPETING

| | |
|---|---|
| 13D11 | EVQLVESGGGLVHPGGSLRLSCVGSGFSLDDYGMTWVRRAPGKGLEWVSSINWSSINMSGTHTDYADSVKGRFTISRDNAKNTLFLQMNSLNPEDTAVYYCQQGWKIVPTNPRGHGTQVTVSS |
| 2B4 | EVQLVESGGGLVQPGGSLRLSCVGSGFSLDDYAMTWVRQAPGKGLEWVSSINWSSINMSGTHTDYADSVKGRFTISRDNAKNTLFLQMNSLNPEDTAVYYCNQGWKIVPTIPMGHGTQVTVSS |
| 2G2 | EVQLVESGGGLVQPGGSLRLSCVASGFSLDDYGMTWVRQAPGKGLEWVSSINWSSINMSGTHTDYPVKGRFTISRDNAKNTLFLQMNNLTPEDTAVYYCNRGWKIVPTDLGGHGTQVTVSS |
| 13D2 | EVQLVESGGGLVQPGGSLRLSCVASGFSLDDYGMTWVRQAPGKGLEWVSSINWSSINMSGTHTDYADSVKGRFTISRDNAKNTLFLQMNNLRSEDTAVYYCNQGWKIVPTDRGHGTQVTVSS |
| 2D5 | EVQLVESGGGLVQPGGSLRLSCVASGFSLDDYGMTWVRQAPGKGLEWVSSINWSSINMSGTHTDYADSVKGRFTISRDNAKNTLFLQMNSLRSEDTAVYYCNQGWKIVPTDRGHGTQVTVSS |
| 2F4 | EVQLVESGGGLVQPGGSLRLSCVASGFSLDDYGMTWVRQAPGKGLEWVSSINWSSINMSGTHTDYADSVKGRFTISRDNAKNTLFLQMNSLRSEDTAVYYCNQGWKIVPTDRRGHGTQVTVSS |
| 2C3 | EVQLVESGGGLVQPGGSLRLSCVASGFSLDDYGMTWVRQAPGKGLEWVSSINWSSINMSGTHTDYADSVKGRFTISRDNAKNTLFLQMNSLRSEDTAVYYCNQGWKIVPTDRTGHGTQVTVSS |
| 17E3 | EVQLVESGGGLVQAGGSLRLSCVASKMTFMRYTMGWYRQAPGKQRDLVA SIDSSGGTNYADSVKGRFTISRDNAKNTVYLEMNSLTPEDTAVYYCNRGWKIVPTDRTGHGTQVTVSS |
| 17H3 | EVQLMESGGGLVQPGGSLRLSCVASGFSLDDYGMTWVRQAPGKGLEWVSSINWSSINMSGTHTDYADSVKGRFTISRDNAKNTLFLQMNSLRSEDTAVYYCNQGWKIVPTDRGGHGTQVTVSS |
| 17D2 | EVQLVESGGGLVQPGGSLRLSCVASGFSLDDYGMTWVRQAPGKGLEWVSSINWSSINMSGTHTDYADSVKGRFTISRDNAKNTLFLQMNSLRSEDTAVYYCNQGWKIVPTDRGGHGTQVTVSS |
| 2F1 | EVQLVESGGGLVQPGGSLRLSCVASGFSLDDYGMTWVRQAPGKELEWVSSINWSSINMSGTHTDYADSVKGRFTISRDNAKNTLFLQMNSLTPEDTAVYYCNQGWKIVPMDRGHGTQVTVSS |
| 2E2 | EVQLVESGGGLVQPGGSLRLSCVASGFSLDDYGMTWVRQAPGKGLEWVSSINWSSINMSGTHTDYADSVKGRFTISRDNAKNTLFLQMNSLTPEDTAIYYCNQGWKIIPTDRRGHGTQVTVSS |
| 2C2 | EVQLVESGGGLVQPGGSLRLSCVASGFSLDDYAMTWVRQAPGKGLEWVSSINWSSINMSGTHTDYADSVKGRFTISRDNARNTLFLQMNSLTPEDTAVYYCNQGWKIIPTDRRGHGTQVTVSS |
| 2E3 | EVQLVESGGGLVQPGGSLRLSCVASGFSLDDYGMTWVRQAPGKGLEWVSSINWSSINMSGTHTDYADSVKGRFTISRDNAKNTLFLQMNSLSPEDTAVYYCNQGWKILPTNRGSHGTQVTVSS |
| 13B10 | EVQLVESGGGLVQPGGSLRLSCVASGFSLDDYGMTWVRQAPGKGFEWVSSINWSSINMSGTHTDYADSVKGRFTISRDNAKNTLFLQMNSLSPEDTAVYYCNQGWKILPTNRGSHGTQVTVSS |
| 2D1 | EVQLVESGGGLVQPGGSLRLSCVASGFSLDDYGMTWVRQAPGKGLEWVSSINWSSINMSGTHTDYADSVKGRFTISRDNAKNTLFLQMNSLSPEDTAVYYCNRGWKILPTNRGSHGTQVTVSS |
| 2H3 | EVQLVESGGGLVQPGGSLRLSCVASGFSLDDYGMTWVRQAPGKGLEWVSSINWSSINMSGTHTDYADSVKGRFTISRDNAKNTLFLQMNSLTPEDTAVYYCNQGWKIIPTDRRGHGTQVTVSS |
| 2H1 | EVQLVESGGGLVQPGGSLRLSCVASGFSLDDYGMTWVRQAPGKGLEWVSSINWSSINMSGTHTDYADSVRGRFVISRDNAKNTLFLQMNSLTPEDTAVYYCNQGWKIIPTDRRGHGTQVTVSS |
| 2C1 | EVQLVESGGGLVQPGGSLRLSCVASGFSLDDYGMTWVRQAPGKGLEWVSSINWSSINMSGTHTDYADSVKGRFTISRDNAKNTLFLQMNSLTPEDTAVYYCNQGWKIIPTDRRGHGTQVTVSS |
| 15C5 | EVQLVESGGGLVQPGGSLKLSCVASGFSLDDYGMTWVRQAPGKGLEWVSSINWSSINMVTHTDYAYSVKGRFTISRDNAKNTLFLQMNSLTPEDTAVYYCNQGWKIIPTDRRGHGTQVTVSS |
| 2B3 | EVQLVESGGGLVQPGGSLRLSCVASGFSLDDYGMTWVRQAPGKGLEWVSSINWSSINMSGTHTDCADSVKGRFTISRDNAKNTLFLQMNSLTPEDTAVYYCNQGWKIIPTDRRGHGTQVTVSS |
| 29H2 | EVQLVESGGGLVQPGGSLRLSCVASGFSLDDYGMTWVRQAPGKGLEWVSSINWSSINMSGTHTDYADSVKGRFTISRDNAKNTLFLQMNNLTPEDTAVYYCNQGWKIIPTDRRGHGTQVTVSS |
| 17E4 | EVQLVESGGGLVQPGGSLRLSCVASGFSLDDYGMTWVRQAPGKGLEWVSSINWSSINMSGTHTDYADSVKGRFVISRDNAKNTLFLQMNSLSPEDTAVYYCNQGWKIIPTDRRGHGTQVTVSS |
| 17A2 | EVQLVESGGGLVQPGGSLRLSCVASGFSLDDYAMTWVRQAPGKGLEWVSSINWSSINMSGTHTDYADSVKGRFTISRDNAKNTLFLQMNSLSPEDTAVYYCNKGWKVMPTDRTHGTQVTVSS |

TABLE C-1-continued

Sequence of HER2 binding Nanobodies aligned by family

| Name | Sequence |
|---|---|
| 15D1 | EVQLVESGGGLVQPGGSLRLRLSCVASGFSLDDYAMTWVRQAPGKGLEWVSSINWSGTHTDYADSVKGRFTISRDNAKNTLFLQMNSLNPEDTAVYYCNQGWKVWPTDRGTHGTQVTVSS |
| 17B8 | EVQLVESGGGLVQPGGSLRLRLSCVASGFSLDDYGMTWVRQAPGKGLEWVSSINWSGTHTDYADSVKGRFTISRDNAKNTLFLQMNSLTPEDTAVYYCNQGWKILPAERRGHGTQVTVSS |
| 15C11 | EVQLVESGGGLVQPGGSLRLRLSCVASGFSLDDYGMTWVRQAPGKGLEWVSSINWSGTHTDYADSVKGRFTISRDNAKNTLFLQMNSLTPEDTAVYYCNQGWKILPAERRGHGTPVTVSS |
| 15G8 | EVQLVESGGGLVQPGGSLKLRLSCVASGFSLDDYGMTWVRQAPGKGLEWVSSINWSGTHTDYAYSVKGRFTISRDNAKNTLFLQMNSLTPENTAVYYCNQGWKILPAERRGHGTQVTVSS |
| 17H4 | EVQLVESGGGLVQPGGSLRLRLSCVASGFSLIMYAMTWVRQAPGKGLEWVSSINWSGTHTDYADSVKGRFTISRDNAKNTLFLHMNNLSPEDTAVYYCGQGWKIHPADRGGHGTQVTVSS |
| 27G8 | EVQLVESGGGLVQPGGSLRLRLSCVASGFSLDDYGMTWVRQAPGKGLEWVSSINWSGTHTDYADSVKGRFTISRDNAKNTLFLQMNSLTPEDTAVYYCNQGWKILPAERRGHGTQVTVSS |
| 38C6 | EVQLVESGGGLVQPGGSLRLRLSCVASGFSLDDYAMTWVRQAPGKGLEWVSSINWSGTHTDYADSVKGRFTISRDNAKNTLFLQMNSLTPEDTAVYYCNQGWKIRPTIPMGHGTQVTVSS |
| 2A4 | EVQLVESGGGLVQPGGSLRLSCAASGFIFDDYAMSWVRQAPGKGLEWVSAINWSGSHRNYADSVKGRFTISRDNAKKTVYLQMNSLQSEDTAVYYCGTGWQSTTKNQGYWGQGTQVTVSS |
| 15G7 | EVQLVESGGGLVQPGGSLRLSCAASGFIFDDYAMSWVRQAPGKGLEWVSAINWSGSHRNYADSVKGRFTISRDNAKKTVYLQMNSLKSEDTAVYYCATGWQSTTKNQGYWGQGTQVTVSS |
| 15B7 | EVQLVESGGGLVQPGGSLRLSCAASGFIFDDYAMSWVRQAPGKGLEWVSAINWSGSHRNYADSVKGRFTISRDNAKKTVYLQMNSLQSEDTAVYYCGTGWQSTTKNQGYWGQGTQVTVSS |
| 5G4 | EVQLVESGGGLVQPGGSLTLSCAGSGFIFDDYAMSWVRQAPGKGLEWVSAINWSGSHRNYADSVKGRFTISRDNAKKTVYLQMNSLKSEDTAVYYCATGWQSTTKNQNYWGQGTQVTVSS |
| 13B2 | EVQLVESGGSLVQPGGSLRLSCAASGFTFDDYAMSWVRQAPGKGLEWVSSINWSGTHTDYADSVKGRFTISRNNAANNTLYLQMNNLKFEDTAVYYCAKNWRDAGTTWFEKSGSAGQGTQVTVSS |
| 2E5 | EVQLVESGGSLVQPGGSLRLSCAASGFTFDDYAMSWVRQAPGKGLEWVSSINWSGTHTDYADSVKGRFTISRNNAANNTLYLQMNNLKFEDTAVYYCAKNWRDAGTTWFEKSGSAGQGTQVTVSS |
| 15G1 | EVQLVESGGESLVQPGGSLRLSCAASGFTFDDYAMSWVRQAPGKGLEWISSINWSGTHTDYADSVKGRFTISRNNAANNTLYLQMNNLKFEDTAVYYCAKNWRDAGTTWFEKSGSAGQGTQVTVSS |
| 27B1 | EVQLVESGGSLVQPGGSLRLSCAASGFTFDDYAMSWVRQAPGKGLEWISSINWSGTHTDYADSVKGRFTISRNNAANNTLYLQMNNLKFEDTAVYYCAKNWRDAGTTWFEKSGSAGQGTQVTVSS |
| 17E7 | EVQLVESGGSLVQPGGSLRLSCAASGFTFDDYAMSWVRQAPGKGLEWISSINWSGTHTDYADSVKGRFTISRNNAANMLYLQMNNLKFEDTAVYYCAKNWRDAGTTWFEKSGSAGQGTQVTVSS |
| 17D8 | EVQLVESGGSLVPPGGSLRLSCAVSGFTFDDYALSWVRQAPGKGLEWISSINWSGTHTDYADSVKGRFTISRNNAANNTLYLQMNNLKFEDTAVYYCAKNWRDAGTTWFEKSGSAGQGTQVTVSS |
| 5F8 | EVQLVESGGSLVQPGGSLRLSCAASGFTFDDYAMTWVRQAPGKGLEWVSSINWSGTHTDYADSVKGRFTISRNNAANNTLYLQMNSLKSDDTAVYYCAKNWGDAGTTWFEKSGSAGPGTQVTVSS |
| 2D4 | EVQLVESGGSLVQPGGSLRLSCAASGFTFDDYAMTWVRQAPGKGLEWVSSINWSGTHTDYADSVKGRFTISRNNAANNTLYLQMNSLKSDDTAVYYCAKNWGDAGTTWFEKSGSAGPGTQVTVSS |
| 13D8 | EVQLVESGGSLVQPGGSLRLSCAASGFTFDDYAMTWVRQASGKGLEWVSSINWSGTHTDYTDSVKGRFTISRNNAANNTLYLQMNSLKSEDTAVYYCAKNWGDAGTTWFEKSGSAGQGTQVTVSS |
| 17G8 | EVQLVESGGSLVQPGGSLRLSCAASGFTFDDYAMTWVRQAPGKGLEWVSSINWSGTHTDYTDSVKGRFTISRNNAANNTLYLQMNSLKSEDTAVYYCAKNWGDAGTTWFEKSGSAGQGTQVTVSS |
| 2H4 | EVQLVESGGSLVQPGGSLRLSCAASGFTFDDYAMTWVRQAPGKGLEWVSSINWSGTHTDYGYTDSVKGRFTISRNNAANNTLYLQMNSLKSEDTAVYYCAKNWGDAGTTWFEKSGSAGQGTQVTVSS |
| 2F3 | EVQLVESGGSLVQPGGSLRLSCAASGFTFDDYAMTWVRQAPGKGLEWVSSINWSGTHTGYTDSVKGRFTISRNNAANNTLYLQMNSLKSDDTAVYYCAKNWGDAGTTWFEKSGSAGQGTQVTVSS |
| 2F5 | EVQLVESGGSLVPPGGSLRLSCAASGFTFDDYAMSWVRQAPGKGLEWVSSINWSGTHTDYTDSVKGRFTISRNNAANNTLYLQMNSLKSEDTAVYYCAKNWGDAGTTWFEKSGSAGQGTQVTVSS |
| 30E10 | KVQLVESGGSLVPPGGSLRLSCAASGFTFDDYAMTWVRQAPGKGLEWVSSINWSGTHTDYTDSVKGRFTISRNNAANNTLYLQMNSLKSEDTAVYYCAKNWGDAGTTWFEKSGSAGQGTQVTVSS |

TABLE C-1-continued

Sequence of HER2 binding Nanobodies aligned by family

| ID | Sequence |
|---|---|
| 29H1 | EVQLVESGGGSLVPPGGSLRLSCAASGFTFDDYAMSWVRQAPGKGLEWVSSINMSGTHTGYTDSVKGRFTISRNNANNTLYLQMNSLKSEDTAVYYCAKNWGDAGTTWFEKSGSAGQGTQVTVSS |
| 17E2 | EVQLVESGGGSLVPPGGSLRLSCAASGFTFDDYGMSWVRQAPGKGLEWVSSINMSGTHTDYTDSVKGRFTISRNNANNTLYLQMNSLKSEDTAVYYCAKNWGDAGTTWFEKSGSAGPGTQVTVSS |
| 2B1 | EVQLVESGGGSLVQPGGSLRLSCAASGFTFDDYAMTWVRQAPGKGLEWVSSINMSGTHTDYTDSVKGRFTISRNNANNTLYLQMNSLKSDDTAVYYCAKNWGDAGTTWFEKSGSAGQGTQVTVSS |
| 2A5 | EVQLVESGGGSLVQPGGSLRLSCATSGFTFDDYAMTWVRQAPGKGLEWVSSINMSGTHTDYTDSVKGRFTISRNNANNTLYLQMNSLKSEDTAVYYCAKNWGDAGTTWFEKSGSAGQGTQVTVSS |
| 13C12 | EVQLVESGGGSLVQPGGSLRLSCAASGFTFDDYAMTWVRQAPGKGLEWVSSINMSGTHTDYTDSVKGRFTISRNNANNTLYLQMNSLKSEDTAVYYCAKNWGDAGTTWFEKSGSAGQGTQVTVSS |
| 17E10 | EVQLVESGGGSLVQPGGSLRLSCAASGFTFDDYAMTWVRQAPGKGLEWVSSINMSGTHTDYTDSVKGRFTISRNNANNTLYLQMNSLKSEDTAVYYCAKNWGDAGTTWFEKSGSAGQGTQVTVSS |
| 27D4 | EVQLVESGGGSLVQPGGSLRLSCAASGFTFDDYAMTWVRQAPGKGLEWVSSINMSGTHTDYADSVKGRFTISRNNANNTLYLQMNSLKSEDTAVYYCAKNWGDAGTTWFEKSGSAGQGTQVTVSS |
| 15F9 | EVQLVESGGGSLVQPGGSLRLSCAASGFTFDDYAMTWVRQASGKGLEWVSSINMSGTHTDYTDSVKGRFTISRNNANNTLYLQMNSLKSDDTAVYYCAKNWGDAGTTWFEKSGSAGQGTQVTVSS |
| 30H9 | EVQLVESGGGSLVPPGGSLRLSCAASGFTFDDYGMSWVRQAPGKGLEWVSSINMSGTHTDYTDSVKGRFTISRNNANNTLYLQMNSLKSEDTAVYYCAKNWGDAGTTWFEKSGSAGQGTQVTVSS |
| 39C1 | EVQLVESGGGSLVQPGGSLRLSCAASGFTFDDYAMTWVRQAPGKGLEWVSSINMSGTHTDYTDSVKGRFTISRNNANNTLYLQMNSLKSEDTAVYYCAKNWGDAGTTWFEKSGSAGQGTQVTVSS |
| 27G2 | EVQLVESGGGSLVQPGGSLRLSCAASGFTFDDYAMTWVRQTPGKGLEWVSSINMSGTHTDYTDSVKGRFTISRNNANNTLYLQMNSLKSDDTAVYYCAKNWGDAGTTWFEKSGSAGQGTQVTVSS |
| 2D3 | EVQLVESGGGSLVQPGGSLRLSCAASGFTFDDYAMSWVRQVPGKGLEWVSSINMSGTHTDYADSVKGRFTISRNNANNTLYLQMNSLKSEDTAVYYCAKNWRDAGTTWFEKSGSAGQGTQVTVSS |
| 5F7 | EVQLVESGGGLVQAGGSLRLSCAASGIFSINTMGWYRQAPGKQRELVALISSIGDTYYADSVKGRFTISRDNAKNTVYLQMNSLKPEDTAVYYCKRFRTAAQGTDYWGQGTQVTVSS |

PBMP118N121_A1_4_OK/1-127

OT-FPB COMPETING

| ID | Sequence |
|---|---|
| 47D5 | KVQLVESGGGFVQTGGSPRLSCAASGRSFSEYAAAWFRQSPGKERDLNAGIMWDGRSLFYADVSVKGRFTISRDNAKNTLHLQMNSLKPEDTAVYYCAYHKTPYTTLELNRPHAFGSWGQGTQVTVSS |

HER2 BINDING

| ID | Sequence |
|---|---|
| 14B11 | EVQLNESGGGLVQPGGSLRLSCAASGSIFGFNDMAWYRQAPGKQRELVALISRVGVTSSADSVKGRFTISRVNAKDTVYLQMNSLKPEDTAVYYCGVETYGSGSSSLMTEYDYWGQGTQVTVSS |
| 14B10 | EVQLVESGGGLVQAGGSLRLSCAVNSRTFSSYGMGWFRQAPGKEREFVATINWSGVTAYADSVKGRFTISRDNAKTVYLQMNSLKPEDTARYYCGVETYGSGSSSLMSEYDYWGQGTQVTVSS |
| 14B4 | EVQLVESGGGLVQAGGSLRLSCAVNSRTFSSRAFSSYGMGWFRQAPGKDREFVATINWSGVTAYADSIKGRFTISRDNAKETVYLQMNSLKPDDTGVYYCAAETYGSGSSSLMSEYDYWGQGTQVTVSS |
| 14C11 | EVQLVESGGGLVQAGGSLRLSCAVSSRAFSSYGMGWFRQAPGKEREFVATINWSGATAYADSIKGRFTISRDNAKETVYLQMNSLKPDDTGVYYCAAETYGSGSSSLMSEYDYWGQGTQVTVSS |
| 14B5 | EVQLVESGGGLVQAGGSLRLSCAVSSRAFSSYGMGWFRQAPGKDREFVATINWSGVTAYADSIKGRFTISRDNAKETVYLQMNSLKPDDTGVYYCAAETYGSGSSSLMSEYDYWGQGTQVTVSS |
| 14C6 | EVQLVESGGGSVQAGGSLRLSCVASEGTFSSYGMGWFRQAPGKERAPGKERAFVATINWSGVNAYADSVKGRFTISRDNAKKTAYLQMNSLKPEDTAVYYCATDTYGSGSSSLMNEYDYWGQGTQVTVSS |
| 14A4 | EVQLVESGGGSVQAGGSLTLSCVASEGTFSSYGMGWFRQAPGKERAFVATINWSGVNAYADSVKGRFTISRDNAKKTAYLQMNSLKPEDTAVYYCAAETYGSGSSSLMNEYDYWGQGTQVTVSS |
| 14B3 | EVQLVESGGGLVQPGGSLTLSCVASEGTFSSYGMGWFRQAPGKERAFVATINWSGVNAYADSVKGRFTISRDNAKKTAYLQMNSLKPEDTAVYYCAAETYGSGSSSLMNEYDYWGQGTQVTVSS |

TABLE C-1-continued

Sequence of HER2 binding Nanobodies aligned by family

| | |
|---|---|
| 14C1 | EVQLVESGGGSVQAGGSLRLSCAASGSTFSSYGMGWFRQAPGKERAFVATINWSGVTAYADSVKGRFTISRDNAKKTVYLQMNSLKPEDTAVYYCATETYGSGSSLMNEYDYWGQGTQVTVSS |
| 14A12 | EVQLNKSGGGLVQAGGSLRLSCAASERTFSSYGMGWFRQAPGKEREFVATINWSGVTAYADSVKGRFTISRDNAKKTVYLQMNSLKPEDTAVYYCAAEPYGSGSSLISEYDYWGHGTQVTVSS |
| 14A2 | EVQLVESGGGLVQAGGSLRLSCAASERTFSSYGMGWFRQAPGKEREFVATINWSGVTAYADSVKGRFTISRDNAKKTVYLQMNSLKPEDTAVYYCAAEPYGSGSSLISEYDYWGHGTQVTVSS |
| 14A1 | EVQLVESGGGSVQAGGSLRLSCAASERTFSSYGMGWFRQAPGKEREFVATINWSGVTAYADSVKGRFTISRDNAKKTVYLQMNSLKPEDTAVYYCAAEPYGSGSSLMSEYDYWGHGTQVTVSS |
| 17C3 | EVQLVESGGGLVQAGGSLRLSCAANGLTFRRYDMGWYRQAPGQGQREWVAAISGAGDINYADSVKGRFTMARDNANHTVHLQMNSLKPEDTAVYYCNANWKMLLGVENDYWGQGTQVTVSS |
| 46D3 | KVQLVESGGGLVQAGGSLRLSCAASGRTFTEYSMGWFRQAPGKEREFVATISWNYGYTYYSDSVKGRFTYTYYYSDSVKGRFTVSRDIAENTVYLQMNTLKSEDTAVYYCAAKIGWLSIRGDEYEYWGQGTQVTVSS |
| 27H5 | EVQLVESGGGLVQAGGSLRLSCAASGFTFDDYGIGWFRQASGKEREGVSCIITSSDGSTYYADSVKGRFTISDNAKNTVYLQMNSLKPEDTAVYYCAALPFVCPSGSYSDYGDEYDYWGQGTQVTVSS |
| 17C2 | EVQLVESGGGLVQPGGSLRLSCAASGFAPSSYAMSWVRQAPGKGLEWVSAVDSGGGRTDYAHSVKGRFTISRDNAKNTLYLQMSSLKPEDTALYYCTKHVSDSDYTEYDYWGQGTQVTVSS |
| 17D11 | EVQLVESGGGLVQAGGSLRLSCTTASGRTSSTSAMGWFRQAPGKEREFVATISRGGSATYYADLKKGRFTISRDNAKNTLYLQMNSLKPEDTAVYYCAARRSSLYTSSNVFEDYWGQGTQVTVSS |
| 15A6 | EVQLVESGGGLVQAGGSLRLSCVTSRRPASTRTMAWFRQAPGKQRDWVATISSHGLPVVADSVKGRFTVSRDNANNTVYLQMNTLKPEDTAVYYCRDVNADYWGQGTQVTVSS |
| 17B6 | EVQLVESGGGLVQAGGSLRLSCAASRIPFSTRTMAWFRQAPGKQRDWVATIGTSGPPRYADSVKGRFTVSRDNAKNTVYLQMNSLKAEDTAVYYCWDVNADYWGQGTQVTVSS |
| 17C5 | EVQLVESGGGLVQAGGSLRLSCVTSRRPASTRTMAWFRQAPGKQRDWVATISSHGLPVYADSVKGRFTVSRDNAKNTVYLQMNTLKPEDTAVYYCRDVNADYWGQGTQVTVSS |
| 15E11 | EVQLVESGGGLVQAGGSLRLSCVASRIPFSSRTMAWFRQAPGKQRDWVATISARGMPAYEDSVKGRFTVSRDNAKNTLYLQMNSLKPEDTAVYYCRDVNADYWGQGTQVTVSS |
| 15C2 | EVQLVESGGGLVQAGGSLRLSCVTSRRPASTRTMAWFRQAPGKQRDWVATISSHGLPVYADSVKGRFTVSRDNANNTVYLQMNTLKPEDTAVYYCRDVNADYWGQGTQVTVSS |
| 2A3 | EVQLVESGGGLVQAGGSLNLSCVASGIPFSTRTMAWYRQAPGKPRDWVA TIRNGAPVYADSVKGRFTVSRDNAKNTLYLQMNSLKPEDTATYLCRDVNGDIWGQGTQVTVSS |
| 27A5 | EVQLVESGGGLVQAGGSLNLSCVASGIPFSTRTMAWYRQPPGNERDWVA TIRSGAPVYADSVKGRFTVSRDNAKNTLYLQMNSLEPEDTATYYCWDVNGDIWGQGTQVTVSS |
| 2C5 | EVQLVESGGGLVQAGGSLNLSCVASGIPFSTRTMAWYRQTPGKSRDWVA TIRSGTPVYADSVKGRFTVSRDNAKNTLYLRMNSLKSEDSATYTCRAVNADIWGQGTQVTVSS |
| 27G5 | EVQLVESGGGLVQPGGSLRLSCVASRIPASIRTMAWYRQTPGNQRDWLATIGSSGTPAYADSVKGRFTVSRDNANHTVYLQMNSLKPEDTAVYYCRDVNGDYWGQGTQVTVSS |
| 13A9 | EVQLVESGGGLVQPGGSLRLSCVASRIPASIRTMAWYRQAPGKQRDWVATIGTVGTTPAYADSVKGRFSFKGRFTVSRDNAKNTVYLQMNSLKPEDTAVYYCRDVNGDYWGQGTQVTVSS |
| 29E9 | EVQLVESGGGLVQPGGSLRLSCVASRIPASIRTMAWYRQTPGNQRDWLATIGSSGTPAYADSVKGRFTVSRDNAKNTVYLQMNSLKPEDTAVYYCRDVNGDYWGQGTQVTVSS |
| 15D8 | EVQLVESGGGLVQPGGSLRLSCVASRIPASIRTMAWYRQTPGNQRDWLATIGSSGTPAYADSVKGRFTVSRDNAKNTVYLQMNSLKPEDTAVYYCRDVNGDYWGQGTQVTVSS |
| 15G4 | EVQLVESGGGLVQPGGSLKLSCVASTIPASIRTMAWYRQTPGNQRDWLATIGSSGTPAYADSVKGRFTVSRDNAKNTVYLQMNSLKPEDTAVYYCRDVNGDYWGQGTQVTVSS |
| 15D12 | EVQLVESGGGLVQAGESLRLSCATSGITFKRYVMGWYRQGPGKQRELVATVNDGGTTSYADSVKGRFAISRDNAKNTAYLQMNSLKAEDTAVYYCNAVWKLPRFVDNDYWGQGTQVTVSS |
| 15E12 | EVQLVESGGGLVQAGGSLRLSCAANGLTFRRYDMGWYRQAPGQGQREWVAAISGAGDINYADSVKGRFTMARDNANHTVHLQMNSLKPEDTAVYYCNANWKMLLGVENDYWGQGTQVTVSS |
| 13D7 | EVQLVESGGGLVQAGGSLRLSCAANGLTFRRYDMGWYRQAPGQGQREWVAAISGAGDINYADSVKGRFTMARDNANHTVHLQMNSLKPEDTAVYYCNANWKMLLGVENDYWGQGTQVTVSS |

TABLE C-1-continued

Sequence of HER2 binding Nanobodies aligned by family

| | |
|---|---|
| 13A8 | EVQLVESGGGLVQPGGSLRLSCAASGLGIAFSRRTMAWYRQAPGKQRDMVATIAGDSTV YADSMKGRFTISRDNAENTVYLQMNSLKPEDTAVYYCWDVNRDYWGQGTQVTVSS |
| 15A4 | EVQLVESGGGLVQPGGSLRLSCAASGLGIAFSRRTMAWYRQAPGKQRDMVATIAGDSTV YADSMKGRFTISRDNAENTVYLQINSLKPEDTAVYYCWDVNRDYWGQGTQVTVSS |
| 17F7 | EVQLVESGGGLVQAGGSLRLSCVASGIAQS IRVMAWYRQPPGKQRDMVGTISSDGTAN YADSVKGRFTISRDNAKKTMYLQMNSLKPDDTAVYYCRDVNRDYWGQGTQVTVSS |
| 17C8 | EVQLVESGGGLVQAGGSLRLSCAASGIAFR IRTMAWYRQAPGKQRDMVATSDSGGTTL YADSVKGRFTVSRDNAENTVYLQMNSLKPEDTAVYYCRDVNRDYWGQGTQVTVSS |
| 17A10 | EVQLVESGGGLVQAGGSLRLSCVASGIPSI RAIAWYRQAPGKQRDMVATSGTGYAT YDDSVKGRFTLSRDNAKNTVYLQMNSLKPEDTAVYYCRDVNRDYWGQGTQVTVSS |
| 27D3 | EVQLMESGGGLVQPGGSLRLSCAASGLGIAFSRRTMAWYRQAPGKQRDMVATIAGDSTV YADSMKGRFTISRDNAENTVYLQMNSLKPEDTAVYYCWDVNRDYWGQGTQVTVSS |
| 13B12 | EVQLVESGGGLVQAGGSLRLSCAASGIAFR IRTMAWYRQAPGKQRDMVATIGSDGTTI YADSVKGRFTLSRHNAENTVYLQMNSLKPEDTAVYYCRDVNRDYWGQGTQVTVSS |
| 15B2 | EVQLVESGGGLVQAGGSLRLSCVVSGIPSS IRAMAWYRQAPGRQRDMVATIYSPSGSAVYADSVKGRFTISSDNAKSTIYLQMNSLKPDDTAVYYCRDVNRDYWGQGTQVTVSS |
| 15B11 | EVQLVESGGGSVQAGGSLRLSCVVSGIPSS IRAMAWYRQAPGRQRDMVATIYSRSGGAVYADSVKGRFTISSDNAKNTIYLQMNSLKPDDTAVYYCRDVNRDYWGQGTQVTVSS |
| 13C9 | EVQLVESGGGLVQPGGSLRLSCVASGIPSI HAMAWYRQAPGKQRDWGATTYSRGG TTYNDSAKGRFTISRDNAKKTVILQMNSLKPEDTAVYYCRDVNRDYWGQGTQVTVSS |
| 17D5 | EVQLVESGGGLVQAGGSLRLSCAASGIIGT SIGTRGAPVYADSVNGRFTISRDGATNTVFLQMNNLKPEDTAVYYCRDVNRDYWGQGTQVTVSS |
| 27B5 | EVQLVESGGGLVQAGGSLRLPCAASGIAFR IRTMAWYRQAPGKQRDWVA TSDSGGTTLYADSVKGRETVSRDNAENTVYLQMNSLKPEDTAVYYCRDVNRDYWGQGTQVTVSS |
| 27C7 | EVQLVESGGGLVQAGGSLRLSCAASGIAFR IRTMAWYRQAPGKQRDWVA TSDSGGTTLYADSVKGRFTVSRDNADNTVYLQMNSLKPEDTAVYYCRDVNRDYWGQGTQVTVSS |
| 13D4 | EVQLVESGGGLVQAGGSLRLSCVVSGIPSS IRAMAWYRQAPGRQRDWVA TIYSPSPGSAVYADSVKGRFTISSDNAKSTIYLQMNSLEPDDTAVYYCRDVNREYWGQGTQVTVSS |
| 15G5 | EVQLVESGGGLVQAGGSLRLSCVVSGIPST IRAMAWYRQAPGRQRDWVA TIYSPSGSAVYADSVKGRFTISSDNAKKTIYLQMNSLKPDDTAVYYCRDVNREYWGQGTQVTVSS |
| 13C4 | EVQLVESGGGLVQAGGSLRLSCVVSGIPSS IRAMAWYRQAPGRQRDWVA TIYSPSGSAVYADSVKGRFTISSDNAKSTIYLQMNSLKPDDTAVYYCRDVNREYWGQGTQVTVSS |
| 46G1 | EVQLVESGGGLVQAGGSLRLSCAASGRTFSDDAMGWFRQAPGKERECVASLYLNGDYPYYADSVKGRFTIYAEAVILQMNNLKTEDTAVYYCAAKPGWVARDPSQYNYWGQGTQVTVSS |
| 46E4 | EVQLVESGGGLVQAGGSLRLSCAASGRAFKDDAVGWFRQAPGKERECVASMYLDGDYPYYADSVKGRFTISRDNAKNAVILQMNNLKTEDTAVYYCAAKPGWVARDPSEYNYWGQGTQVTVSS |
| 17B5 | EVQLVESGGGLVQTGGSLRLSCAASGSTFRTDMMGWYRQAPGKQREFVASITKFGSTNYADSVKGRFTISNDNAKDTVYLQMNSLKSEDTAVYYCRNFNRDLWGQGTQVTVSS |
| 15C9 | EVQLVESGGGLVQAGGSLRLSCVNSGIPSTLRAMAWYRQAPGRQRDWVATSSNTGGTTYDDSVKGRFTISRDNAKNTVYLQMNSLKPEDTGVYYCRDVNRDLWGQGTQVTVSS |
| 13D10 | EVQLVESGGGLVQPGGSLRLSCAASSVITLDSNAIGHFRQAPGKEREEVSCIASSDGSTYYAEBSVKGRFTISKDYTRNTVYLQVNSLKPEDTAVYHCATDANPNCGLNVWNSWGQGTQVTVSS |
| 17C6 | EVQLVESGGGLVQAGGSLTLSCAASGSTSSLDIMAWYRQAPEKQRELVASVSGGGNSDYASSVKGRFTISGDTAKSTLYLQMNSLKPEDTAMYYCYGRDYYMPFWGQGTQVTVSS |
| 15A2 | EVQLVESGGGLVQAGAAGGSLSLSCAASGRFFS TRVMAWYRQTPGKQREFVASMRGSGSTNYADSARGRFAISRDNAKNTVYLQMNSLKPEDTAVYYCRDINEDQWGQGTQVTVSS |
| 17A8 | EVQLVESGGGLVQAGGSLSLSCAASGRFFS TRVMAWYRQTPGKQREFVASMRGSGSTNYADSVRGRFAISRDNAKNMVYLQMNTLKPEDTAVYYCRDINEDQWGQGTQVTVSS |
| 15G10 | EVQLVESGGGLVQAGGSLSLSCAASGRFFS TRVMAWYRQTPGKQREFVASMRGSGSTNYADSARGRFAISRDNAKNTVYLQMNSLKPEDTAVYYCRDINEDQWGQGTQVTVSS |
| 27A3 | EVQLVESGGGLVQAGGSLSLSCVASGRFFS TRVMAWYRQTPGKQREFVASMRGSGSTNYADSVRGRFAISRDNAKNTVYLQMNTLKPEDTAVYYCRDINEDQWGQGTQVTVSS |

TABLE C-1-continued

Sequence of HER2 binding Nanobodies aligned by family

| | |
|---|---|
| 17H10 | EVQLVESGGGLVQAGGSLSLSCCASGRFFS TRVMAWYRQTPGNQREFVATIHSSGSTIYADSVRGRFAISRDNAKNTVYLQMRSLKPEDTAVYYCRDINADQWGQGTQVTVSS |
| 30D10 | EVQLVESGGGLVQAGGSLTLSCTASETTVR IRTMAWYRQPPGNQREWVATIGSNGFATYPDSVKGRFTISRDNAKNTVYLQMNSLKPEDTAVYYCRDINRDIWGQGSQVTVSS |
| 15H4 | EVQLVESGGGLVQAGGSLTLSCAPSESTVS FNTVAWYRQAPGEQREWVATISRQGMSTYPDSVKGRFTISRDNAKNTVYLQMNNLKPEDTAVYYCRDINNHDIWGRGSQVTVSS |
| 17B7 | EVQLVESGGGLVQAGGSLRLSCAASGIISS FRTMAWYRQAPGKQRDWVATIGSDGLANYADSVKGRFTISRDNAKKTVYLQMNSLKPEDTAVYFCRDINRDYWGQGTQVTVSS |
| 15D2 | EVQLVESGGGLVQAGGSLRLSCVVSGVFGP IRAMAWYRQAPGKQRDWVATIGSSGHPVYTDSVKGRFTFSKDGAKNTVYLQMNSLKPEDTAVYYCRDINRDYWGQGTQVTVSS |
| 17G5 | EVQLVESGGGLVQPGGSLRLSCAASGIGIAFSSRTMAWYRQAPGKQRDWVATIGSSGTTNYADSVRGRFTISRDNAKNTVYLQMNSLKPEDTAVYYCRDINRDYWGQGTQVTVSS |
| 15B6 | EVQLVESGGGLVQPGGSLRLSCAASGIIGS FRTMAWYRQAPGNQRDWVATIGSRGLASYADSVRGRFTLSRDNAKKTVYLQMNSLKPEDTAIYYCRDINGDYWGQGTQVTVSS |
| 27F2 | EVQLVESGGGLVQAGGSLRLSCAASGIISSFRTLAWYRQAPGKQRDWVATISSAGGTAYADAVKGRFTISISRDNVEYTVDLQMDSLKPEDTAVYYCRDINGDYWGQGTQVTVSS |
| 17F5 | EVQLVESGGGLVQPGGSLRLSCAASGLGIAFSRRTMAWYRQAPGKQRDWVATIAGDGSTVYADSMKGRFTISRDNAKNTVYLQVNSLKPEDTAVYYCWDTNGDYWGQGTQVTVSS |
| 17B2 | EVQLVESGGGLVQPGGSLRLSCAGSGFTFSNYAMTWVRQAPGKGLEWVSGVGGDGVGSYADSVKGRFTISRDNAKNTLYLQMNSLKPEDTALYYCTKDISTFGWGPFDYWGQGTQVTVSS |
| 27H4 | EVQLVESGGGLVQAGGSLRLSCVASKMTFMRYTMGWYRQAPGKQRDLVASIDASGTNYADSVKGRFTISRDNAKNTVYLEMNSLKPEDTGVYYCNGRWDIVGAIWWGQGTQVTVSS |
| 13A4 | EVQLVESGGGLVQAGDSLRLSCVASKMTFMRYTMGWYRQAPGKQRDLVASIDSSGGTNYADSVKGRFTISRDNAKNTVYLEMNSLKPEDTGVYYCNGRWDIVGAIWWGQGTQVTVSS |
| 2A1 | EVQLVESGGGLVQPGGSLRLSCVASKITFRRYIMDWYRQAPGKQRELVASINSDGSTGYTDSVKGRFTISRDNTKNTLDLQMNSLKPEDTAVYYCHGRWLEIGAEYWGQGTQVTVSS |
| 15E10 | EVQLVESGGGLVQAGGSLKLSCVASGITFFFRYTMGWYRQAPGKERELVAEISSADEPSFADAVKGRFTISRDNAKNTVVLQMNGLKPEDTAVYYCKGSWSYPGLTYWGKGTLVTVSS |
| 27E7 | EVQLVESGGGLVQAGGSLRLSCAASGITFRRYDMGWYRQFPPGKERELVATILSEGDTNYVDPVKGRFTISRDNAKNTVYLQMNDLKPEDTAVYYCNGWRAIGRTYWGQGTQVTVSS |
| 47E5 | EVQLVESGGGLVQAGGSLRLSCAASIPGFDSMGWYRQAPGNERILVAIISNGGTTSYRDSVKGRFTIARDNAKNTVSLQMNSLKPEDTAVYYCNLDRRSYNGRQYWGQGTQVTVSS |
| 2G4 | EVQLVESGGGLVQAGGSLRLSCAASGNIFSHNAMGWYRQAPGKQRELVTYIITNGIANYVDSVKGRFTISRDNTKNTMYLQMVSLKPEDTAVYYCNVGGREYSGVYYREYWGQGTQVTVSS |
| 14D4 | EVQLVESGGGLVQAGDSLRLSCAASGRALDTYVMGWFRQAPGDGREFVAHIFRSGITSYASSVKGRFTISRDNAKNTVYLQMASLKPEDTAAYYCAARPSDTTWSESSASWQGTQVTVSS |
| 17A5 | EVQLVESGGGLVQPGGSLRLSCAASGFTFDDYSMSWVRQATGKGLEWVSGISWNGGSTNYADSVKGRFTISRDNVKNTLYLQMNSLKPEDTAVYYCAKDLGNSGRGPYTNWGQGTQVTVSS |
| 15D10 | EVQLVESGGGLVQAGGSLRLSCAASGFTFSSYRMYWVRQAPGKGLEWVSAIKPDGSITTYYADSVKGRFTISRDNAKNTVYLQMNSLKPEDTAVYYCATDCGVPGFGWTFSSWGQGTQVTVSS |
| 13C2 | EVQLVESGGGLVQAGGSLRLSCAASGSTFSINRMAWYRQSPGKQRELVAAVDNDDNTEYSDSVAGRFTISRDNAKNAVHLQMNSLRLEDTAVYYCNAKQLPYLQNFWGQGTQVTVSS |
| 17G11 | EVQLVESGGGLVQAGGSLRLSCAASGSTFSINRWGWYRQAPGKQRELVAAIDDGGNTEYSDFVNGRFTISRDNPETAVHLQMNSLKLEDTAVYYCNAKQLPYLQNFWGQGTQVTVSS |
| 17A3 | EVQLVESGGGLVQAGGSLSLSCAASATLHRFDNNWYRQAPGKQRELVATIAHDGSTNYANSVKGRFTISRDNARDTLFLQMHALQPEDTAVMCNLHRWGLNYWGQGTQVTVSS |
| 27B7 | EVQLVESGGGLVQPGGSLRLSCAASGFTFSSYAMSWVRQAPGKGLEWVSAISSGGGSITTYADSVKGRFTISRDNAKNTLYLQMSSLKPEDTALYYCAKARSSSSYYDFGSWGQGTQVTVSS |
| 17A6 | EVQLVESGGGLVQPGGSLRLSCAASGFTFSSYAMSWVRQAPGKGLEWVSAISGGGSITTYADSVKGRFTISTDNAKNTLYLQMSSLKPEDTALYYCAKARSSSSYYDFGSWGQGTQVTVSS |

TABLE C-1-continued

Sequence of HER2 binding Nanobodies aligned by family

| | |
|---|---|
| 17D7 | EVQLVESGGGLVQPGGSLRLSCAASGFTLDYCAIGWFRQAPGKEREGVSCISSSDGSTYYADSVKGRFTISRDNAKNTVYLQMNSLKPEDTAVYYCATDRGSGTCYADFGSWGQGTQVTVSS |
| 46D4 | EVQLVESGGGLVQPGGSLRLSCAASGFIFDDYAMSWVRQAPGKGLEWVSSINWSGTHTDYAEDMKGRFTISRDNAKKTLYLQMNSLQSEDTAVYYCAKGWGPAVTSIPVATLGTQVTVSS |
| 27B3 | EVQLVESGGGLVQAGGSLTLSCTASETTV RIRTMAWYRQPPGNQREWVATIGSNGFATYPDSVKGRFTISRDNAKNTVYLQMNSLKPEDTAVYYCRDINRDIWGQGSQVTVSS |
| 27E5 | EVQLVESGGGLVQAGGSLTLSCTASETTV RIRTMAWYRQPPGNQREWVATIGSNGFATYPDSVKGRFTISRDNAKNTVYLQMNSLKPEDTAVYYCRDINRDIWGQGSQVTVSS |
| 27D6 | EVQLVESGGGLVQAGGSLTLSCTASETTV RIRTMAWYRQPPGNQREWVATIGSNGFATYPDSVKGRFTISRDNAKNTVYLQMNSLKPEDTAVYYCRDINRDIWGQGSQVTVSS |
| 30D10 | EVQLVESGGGLVQAGGSLTLSCTASETTV RIRTMAWYRQPPGNQREWVATIGSNGFATYPDSVKGRFTISRDNAKNTVYLQMNSLKPEDTAVYYCRDINRDIWGQGSQVTVSS |
| 47G11 | EVQLVESGGGLVQPGGSLRLSCAASGRIFYPMGWFRQAPGKEREFVAAIGSGDIITYYADSVKGRFTISRDNAKNTVYLQMNSLKPEDTAVYYCASSRDYSRSRDPTSYDRWGQGTQVTVSS |
| 27C3 | EVQLVESGGGLVQPGGSLRLSCAASGFTFDDYATSWVRQAPGKGPEWVSAINSGGGSTYYADSVKGRFTISRDNAKNTLYLQMNSLKPEDTAVYYCARPRGSSLYLLEYDYWGQGTQVTVSS |

TABLE C-2

$k_{off}$ rate of different Nanobodies as measured in Biacore

| ID | $k_{off}$ (s⁻¹) |
|---|---|
| 2A4 | 2.05E−03 |
| 2A5 | 1.42E−03 |
| 2A6 | 1.65E−03 |
| 2B1 | 1.55E−03 |
| 2C4 | 1.26E−03 |
| 2D2 | 1.61E−03 |
| 2D4 | 1.65E−03 |
| 2F2 | 1.65E−03 |
| 2F3 | 1.53E−03 |
| 2F5 | 1.57E−03 |
| 2G5 | 1.56E−03 |
| 2H4 | 1.61E−03 |
| 2B2 | 1.19E−03 |
| 2B3 | 1.25E−03 |
| 2B4 | 2.77E−03 |
| 2B5 | 1.15E−03 |
| 2C1 | 1.18E−03 |
| 2C2 | 4.12E−03 |
| 2C3 | 1.11E−03 |
| 2D1 | 1.27E−03 |
| 2D5 | 1.20E−03 |
| 2F1 | 1.77E−03 |
| 2F4 | 1.07E−03 |
| 2G1 | 1.23E−03 |
| 2G2 | 1.30E−03 |
| 2G3 | 1.20E−03 |
| 2H1 | 1.09E−03 |
| 2H2 | 1.18E−03 |
| 2H3 | 1.15E−03 |
| 2H5 | 1.21E−03 |

TABLE C-3

Overview of $k_a/k_{off}$, $k_a$-, and $K_d$-values for binding of Nanobodies 2D3, 5F7 and 47D5 to HER2. Fusion of a dummy Nanobody at the N-terminal end of the Nanobodies 2D3 and 47D5 does not significantly impact on the binding characteristics of 2D3 or 47D5 respectively.

| Nanobody ID | $k_{off}$ (s⁻¹) | $K_{on}$ (1/Ms) | $K_D$ (nM) |
|---|---|---|---|
| 2D3 | 1.48E−03 | 1.36E+06 | 1.09 |
| Dummy-2D3 | 1.13E−03 | 1.16E+06 | 1.77 |
| 5F7 | 3.02E−04 | 1.02E+06 | 0.29 |
| 47D5 | 8.62E−04 | 3.86E+05 | 2.23 |
| Dummy-47D5 | 8.69E−04 | 2.71E+05 | 3.21 |

TABLE C-4

Off-rate analysis of HER2-ECD on 2D3, 47D5 and 2D3-35GS-47D5 coated sensor chips

| Analyte | Protein on sensor chip | $k_{off}$ (1/s) |
|---|---|---|
| 100 nM Her2 ECD | 2D3-47D5 | 8.07E−5 |
| 100 nM Her2 ECD | 2D3 | 2.10E−3 |
| 100 nM Her2 ECD | 5F7 | 2.56E−3 |
| 1000 nM Her2 ECD | 2D3-47D5 | 5.45E−5 |
| 1000 nM Her2 ECD | 2D3 | 1.51E−3 |
| 1000 nM Her2 ECD | 5F7 | 1.31E−3 |

TABLE C-5

Oligonucleotide primers used for generation of Omnitarg light chain $V_l$ + $C_l$ by overlap extension

| For-sequences | SEQ ID NO | Rev-sequences | SEQ ID NO |
|---|---|---|---|
| >For_LCrescuepAX51<br>tgattacgccaagct | 2396 | >Rev_LC1pAX51<br>TAATAACAATCCAGCGGCTGCCGTAG<br>GCAATAGGTATTTCATGTTGAAAATC<br>T | 2408 |
| >For_LC1pAX51<br>tgattacgccaagcttgcatgca<br>aattctatttcaaggagattttc<br>aacatga | 2397 | >Rev_LC2_OT<br>ATCGCCGACGGACGCGCTCAGGCTAC<br>TCGGAGATTGCGTCATCTGGATGTCG<br>GC | 2409 |
| >For_LC2pAX51_OT<br>gctggattgttattactcgcggc<br>ccagccggccatggccGACATCC<br>AGATGACG | 2398 | >Rev_LC3_OT<br>CCGGCTTCTGTTGATACCAAGCAACC<br>CCGATAGATACGTCCTGACTTGCT | 2410 |
| >For_LC3_OT<br>GCGTCCGTCGGCGATCGCGTTAC<br>CATCACATGCAAAGCAAGTCAGG<br>ACGT | 2399 | >Rev_LC4_OT<br>CCGCTGAAACGGGAAGGCACACCGGT<br>GTAACGATATGATGCGGAGTAAAT | 2411 |
| >For_LC4_OT<br>ATCAACAGAAGCCGGGCAAGGCT<br>CCGAAATTGCTCATTTACTCCGC<br>ATCA | 2400 | >Rev_LC5_OT<br>ATAGTAGGTGGCGAAGTCCTCTGGCT<br>GCAGGCTAGAGATAGTCAGGGTAA | 2412 |
| >For_LC5_OT<br>TTCCCGTTTCAGCGGAAGCGGCT<br>CGGGTACTGATTTTACCCTGACT<br>ATCT | 2401 | >Rev_LC6_OT<br>TACCGTACGTTTAATTTCCACTTTCG<br>TACCCTGGCCAAAGGTATACGGGT | 2413 |
| >For_LC6_OT<br>TTCGCCACCTACTATTGTCAGCA<br>ATACTATATTTACCCGTATACCT<br>TTGG | 2402 | >Rev_LCrescue_VL_OT<br>TCGGAAGGCGGAAAG | 2414 |

TABLE C-5-continued

Oligonucleotide primers used for generation of Omnitarg light chain V$_L$ + C$_L$ by overlap extension

| For-sequences | SEQ ID NO | Rev-sequences | SEQ ID NO |
|---|---|---|---|
| >For_LC7_OT<br>ATTAAACGTACGGTAGCTGCCCC<br>TAGCGTGTTTATCTTTCCGCCTT<br>CCGA | 2403 | >Rev_LC7<br>ATACGACGCTGGCCGTACCACTTTTC<br>AGCTGCTCGTCGGAAGGCGGAAAG | 2415 |
| >For_LC8<br>CGGCCAGCGTCGTATGTTTACTG<br>AATAACTTCTATCCGCGCGAAGC<br>TAAA | 2404 | >Rev_LC8<br>CCGGACTGCAGTGCATTATCCACTTT<br>CCATTGGACTTTAGCTTCGCGCGG | 2416 |
| >For_LC9<br>TGCACTGCAGTCCGGCAATTCTC<br>AAGAATCCGTGACGGAACAAGAT<br>AGCA | 2405 | >Rev_LC9<br>GGTCAGGGTAGAGCTCAGTGAGTAAG<br>TGCTATCTTTGCTATCTTGTTCCG | 2417 |
| >For_LC10<br>AGCTCTACCCTGACCTTGTCAAA<br>GGCAGATTATGAAAAACACAAAG<br>TTTA | 2406 | >Rev_LC10<br>GAAAGTCCCTGATGGGTCACTTCACA<br>GGCGTAAACTTTGTGTTTT | 2418 |
| >For_LC11<br>CCATCAGGGACTTTCGAGTCCGG<br>TTACAAAGTCTTTTAACCGCGG | 2407 | >Rev_LC11<br>aaatagaattggcgcgccttattaGC<br>ACTCACCGCGGTTAAAAGAC | 2419 |
| | | >Rev_LCrescue<br>aaatagaattggcgc | 2420 |

TABLE C-6

Oligonucleotide primers used for generation of Omnitarg heavy chain V$_H$ + CH$_1$ by overlap extension

| For | SEQ ID NO | Rev | SEQ ID NO |
|---|---|---|---|
| >For_HCrescue<br>gtgctaataaggcgc | 2421 | >Rev_HC1<br>AAAGGTACCACTAAAGGAATTGCGAA<br>TAATAATTTTTTCACTATGACTGT | 2434 |
| >For_HC1<br>gtgctaataaggcgcgccaattctat<br>ttcaaggagacagtcatagtgaaa | 2422 | >Rev_HC2_OT<br>ACGCAGAGAACCGCCTGGCTGCACCA<br>GCCCACCTCCGCTTTCCACCAGCT | 2435 |
| >For_HC2_OT<br>tttagtggtaccttctattctcact<br>ccGAGGTTCAGCTGGTGGAAAGCG | 2423 | >Rev_HC3_OT<br>TTTCACGTTCACTGATTATACCATGG<br>ATTGGGTTCGCCAGGCGCCGGGTA | 2436 |
| >For_HC3_OT<br>GGCGGTTCTCTGCGTCTGAGCTGCGC<br>TGCCTCCGGTTTCACGTTCACTGA | 2424 | >Rev_HC4_OT<br>CCCTTAAAACGTTGGTTGTAAATTGA<br>GCCACCAGAGTTAGGGTTTACGTC | 2437 |
| >For_HC4_OT<br>GCCAGGCGCCGGGTAAAGGCCTTGAA<br>TGGGTGGCCGACGTAAACCCTAAC | 2425 | >Rev_HC5_OT<br>TTCTGCACGCAGCGAATTCATCGTA<br>AATAGAGTGTGTTTTTAGAGCGAT | 2438 |
| >For_HC5_OT<br>CCAACGTTTTAAGGGTCGTTTCACCC<br>TGAGCGTAGATCGCTCTAAAAACA | 2426 | >Rev_HC6_OT<br>TGCCTTGGCCCCAATAGTCAAAGTAA<br>AAGGACGGGCCCAGATTGCGTGCA | 2439 |
| >For_HC6_OT<br>TCGCTGCCTGCAGAAGACACCGCTGT<br>TTATTACTGTGCACGCAATCTGGG | 2427 | >Rev_HC7<br>GATTTCGAGCTTGGGGCCAGCGGAAA<br>CACTGACGGACCTTTAGTGCTTGC | 2440 |
| >For_HC7_OT<br>ATTGGGGCCAAGGCACGTTGGTCACC<br>GTGAGTAGCGCAAGCACTAAAGGT | 2428 | >Rev_HCrescue_VH_OT<br>GATTTCGAGCTTGGG | 2441 |
| >Rev_HC7_OT_PCR<br>ACCTTTAGTGCTTGCGCTACTCACGG<br>TGACCAACGTGCCTTGGCCCCAAT | 2429 | >Rev_HC8<br>GGAGACAGTGACCGGTTCCGGGAAGT<br>AATCTTTCACCAGACAGCCCAGCG | 2442 |

TABLE C-6-continued

Oligonucleotide primers used for generation of
Omnitarg heavy chain V$_H$ + CH$_1$ by overlap extension

| For | SEQ ID NO | Rev | SEQ ID NO |
|---|---|---|---|
| >For_HC8<br>CCCAAGCTCGAAATCCACGTCCGGTG<br>GCACCGCCGCGCTGGGCTGTCTGG | 2430 | >Rev_HC9<br>TATACAAGCCGCTAGACTGCAAAACC<br>GCAGGGAAAGTATGTACACCCGAG | 2443 |
| >For_HC9<br>CCGGTCACTGTCTCCTGGAACTCGGG<br>TGCACTTACCTCGGGTGTACATAC | 2431 | >Rev_HC10<br>TGGTTCACATTGCAAATATACGTCTG<br>GGTGCCCAGAGAGCTTGAAGGCAC | 2444 |
| >For_HC10<br>CTAGCGGCTTGTATAGCCTGTCAAGC<br>GTTGTGACCGTGCCTTCAAGCTCT | 2432 | >Rev_HC11<br>TTTTTGTTCTGCGGCCGCACAGCTCT<br>TCGGTTCCACTTTCTTATCCA | 2445 |
| >For_HC11<br>TTGCAATGTGAACCACAAACCGAGTA<br>ACACCAAAGTGGATAAGAAAGTGG | 2433 | >Rev_HCrescue<br>TTTTTGTTCTGCGGC | 2446 |

SEQUENCE LISTING (2482 sequences)

SEQ ID NO: 1 - protein, 102 aa, Artificial
  KERE-class Nanobody
  misc_feature (31)..(35): Xaa is any amino acid
  misc_feature (50)..(54): Xaa is any amino acid
  misc_feature (87)..(91): Xaa is any amino acid
EVQLVESGGGLVQPGGSLRLSCAASGIPFSXXXXXWFRQAPGKQRDSVAXXXXXRFTISRDNAKNTVYLQMNSLKPEDTAVYRCYFXXXXXWGQGTQVTVSS

SEQ ID NO: 2 - protein, 102 aa, Artificial
  KERE-class Nanobody
  misc_feature (31)..(35): Xaa is any amino acid
  misc_feature (50)..(54): Xaa is any amino acid
  misc_feature (87)..(91): Xaa is any amino acid
QVKLEESGGGLVQAGGSLRLSCVGSGRTFSXXXXXWFRLAPGKEREFVAXXXXXRFTISRDTASNRGYLHMNNLTPEDTAVYYCAAXXXXXWGQGTQVTVSS

SEQ ID NO: 3 - protein, 102 aa, Artificial
  KERE-class Nanobody
  misc_feature (31)..(35): Xaa is any amino acid
  misc_feature (50)..(54): Xaa is any amino acid
  misc_feature (87)..(91): Xaa is any amino acid
AVQLVDSGGGLVQAGDSLKLSCALTGGAFTXXXXXWFRQTPGREREFVAXXXXXRFTISRDNAKNMVYLRMNSLIPEDAAVYSCAAXXXXXWGQGTLVTVSS

SEQ ID NO: 4 - protein, 102 aa, Artificial
  KERE-class Nanobody
  misc_feature (31)..(35): Xaa is any amino acid
  misc_feature (50)..(54): Xaa is any amino acid
  misc_feature (87)..(91): Xaa is any amino acid
QVQLVESGGGLVEAGGSLRLSCTASESPFRXXXXXWFRQTSGQEREFVAXXXXXRFTISRDDAKNTVWLHGSTLKPEDTAVYYCAAXXXXXWGQGTQVTVSS

SEQ ID NO: 5 - protein, 102 aa, Artificial
  KERE-class Nanobody
  misc_feature (31)..(35): Xaa is any amino acid
  misc_feature (50)..(54): Xaa is any amino acid
  misc_feature (87)..(91): Xaa is any amino acid
AVQLVESGGGLVQGGGSLRLACAASERIFDXXXXXWYRQGPGNERELVAXXXXXRFTISMDYTKQTVYLHMNSLRPEDTGLYYCKIXXXXXWGQGTQVTVSS

SEQ ID NO: 6 - protein, 102 aa, Artificial
  KERE-class Nanobody
  misc_feature (31)..(35): Xaa is any amino acid
  misc_feature (50)..(54): Xaa is any amino acid
  misc_feature (87)..(91): Xaa is any amino acid
DVKFVESGGGLVQAGGSLRLSCVASGFNFDXXXXXWFRQAPGKEREEVAXXXXXRFTISSEKDKNSVYLQMNSLKPEDTALYICAGXXXXXWGRGTQVTVSS

SEQ ID NO: 7 - protein, 102 aa, Artificial
  KERE-class Nanobody
  misc_feature (31)..(35): Xaa is any amino acid
  misc_feature (50)..(54): Xaa is any amino acid
  misc_feature (87)..(91): Xaa is any amino acid
QVRLAESGGGLVQSGGSLRLSCVASGSTYTXXXXXWYRQYPGKQRALVAXXXXXRFTIARDSTKDTFCLQMNNLKPEDTAVYYCYAXXXXXWGQGTQVTVSS

SEQ ID NO: 8 - protein, 102 aa, Artificial
  KERE-class Nanobody
  misc_feature (31)..(35): Xaa is any amino acid
  misc_feature (50)..(54): Xaa is any amino acid
  misc_feature (87)..(91): Xaa is any amino acid
EVQLVESGGGLVQAGGSLRLSCAASGFTSDXXXXXWFRQAPGKPREGVSXXXXXRFTISTDNAKNTVHLLMNRVNAEDTALYYCAVXXXXXWGRGTRVTVSS

SEQ ID NO: 9 - protein, 102 aa, Artificial
  KERE-class Nanobody
  misc_feature (31)..(35): Xaa is any amino acid
  misc_feature (50)..(54): Xaa is any amino acid
  misc_feature (87)..(91): Xaa is any amino acid
QVQLVESGGGLVQPGGSLRLSCQASGDISTXXXXXWYRQVPGKLREFVAXXXXXRFTISGDNAKRAIYLQMNNLKPDDTAVYYCNRXXXXXWGQGTQVTVSP

SEQ ID NO: 10 - protein, 102 aa, Artificial
  KERE-class Nanobody
  misc_feature (31)..(35): Xaa is any amino acid
  misc_feature (50)..(54): Xaa is any amino acid
  misc_feature (87)..(91): Xaa is any amino acid
QVPVVESGGGLVQAGDSLRLFCAVPSFTSTXXXXXWFRQAPGKEREFVAXXXXXRFTISRNATKNTLTLRMDSLKPEDTAVYYCAAXXXXXWGQGTQVTVSS

SEQ ID NO: 11 - protein, 102 aa, Artificial
  KERE-class Nanobody
  misc_feature (31)..(35): Xaa is any amino acid
  misc_feature (50)..(54): Xaa is any amino acid
  misc_feature (87)..(91): Xaa is any amino acid
EVQLVESGGGLVQAGDSLRLFCTVSGGTASXXXXXWFRQAPGEKREFVAXXXXXRFTIARENAGNMVYLQMNNLKPDDTALYTCAAXXXXXWGRGTQVTVSS

SEQ ID NO: 12 - protein, 102 aa, Artificial
  KERE-class Nanobody
  misc_feature (31)..(35): Xaa is any amino acid
  misc_feature (50)..(54): Xaa is any amino acid
  misc_feature (87)..(91): Xaa is any amino acid
AVQLVESGGDSVQPGDSQTLSCAASGRTNSXXXXXWFRQAPGKERVFLAXXXXXRFTISRDSAKNMMYLQMNNLKPQDTAVYYCAAXXXXXWGQGTQVTVSS

SEQ ID NO: 13 - protein, 102 aa, Artificial
  KERE-class Nanobody
  misc_feature (31)..(35): Xaa is any amino acid
  misc_feature (50)..(54): Xaa is any amino acid
  misc_feature (87)..(91): Xaa is any amino acid
AVQLVESGGGLVQAGGSLRLSCVVSGLTSSXXXXXWFRQTPWQERDFVAXXXXXRFTISRDNYKDTVLLEMNFLKPEDTAIYYCAAXXXXXWGQGTQVTVSS

SEQ ID NO: 14 - protein, 102 aa, Artificial
  KERE-class Nanobody
  misc_feature (31)..(35): Xaa is any amino acid
  misc_feature (50)..(54): Xaa is any amino acid
  misc_feature (87)..(91): Xaa is any amino acid
AVQLVESGGGLVQAGASLRLSCATSTRTLDXXXXXWFRQAPGRDREFVAXXXXXRFTVSRDSAENTVALQMNSLKPEDTAVYYCAAXXXXXWGQGTRVTVSS

SEQ ID NO: 15 - protein, 102 aa, Artificial
  KERE-class Nanobody
  misc_feature (31)..(35): Xaa is any amino acid
  misc_feature (50)..(54): Xaa is any amino acid
  misc_feature (87)..(91): Xaa is any amino acid
QVQLVESGGGLVQPGGSLRLSCTVSRLTAHXXXXXWFRQAPGKEREAVSXXXXXRFTISRDYAGNTAFLQMDSLKPEDTGVYYCATXXXXXWGQGTQVTVSS

SEQ ID NO: 16 - protein, 102 aa, Artificial
  KERE-class Nanobody
  misc_feature (31)..(35): Xaa is any amino acid
  misc_feature (50)..(54): Xaa is any amino acid
  misc_feature (87)..(91): Xaa is any amino acid
EVQLVESGGELVQAGGSLKLSCTASGRNFVXXXXXWFRRAPGKEREFVAXXXXXRFTVSRDNGKNTAYLRMNSLKPEDTADYYCAVXXXXXLGSGTQVTVSS

SEQ ID NO: 17 - protein, 102 aa, Artificial
  GLEW-class Nanobody
  misc_feature (31)..(35): Xaa is any amino acid
  misc_feature (50)..(54): Xaa is any amino acid
  misc_feature (87)..(91): Xaa is any amino acid
AVQLVESGGGLVQPGGSLRLSCAASGFTFSXXXXXWVRQAPGKVLEWVSXXXXXRFTISRDNAKNTLYLQMNSLKPEDTAVYYCVKXXXXXGSQGTQVTVSS

SEQ ID NO: 18 - protein, 102 aa, Artificial
  GLEW-class Nanobody
  misc_feature (31)..(35): Xaa is any amino acid
  misc_feature (50)..(54): Xaa is any amino acid
  misc_feature (87)..(91): Xaa is any amino acid
EVQLVESGGGLVQPGGSLRLSCVCVSSGCTXXXXXWVRQAPGKAEEWVSXXXXXRFKISRDNAKKTLYLQMNSLGPEDTAMYYCQRXXXXXRGQGTQVTVSS

SEQ ID NO: 19 - protein, 102 aa, Artificial
  GLEW-class Nanobody
  misc_feature (31)..(35): Xaa is any amino acid
  misc_feature (50)..(54): Xaa is any amino acid
  misc_feature (87)..(91): Xaa is any amino acid
EVQLVESGGGLALPGGSLTLSCVFSGSTFSXXXXXWVRHTPGKAEEWVSXXXXXRFTISRDNAKNTLYLEMNSLSPEDTAMYYCGRXXXXXRSKGIQVTVSS

SEQ ID NO: 20 - protein, 102 aa, Artificial
  P,R,S 103-class Nanobody
  misc_feature (31)..(35): Xaa is any amino acid
  misc_feature (50)..(54): Xaa is any amino acid
  misc_feature (87)..(91): Xaa is any amino acid
AVQLVESGGGLVQAGGSLRLSCAASGRTFSXXXXXWFRQAPGKEREFVAXXXXXRFTISRDNAKNTVYLQMNSLKPEDTAVYYCAAXXXXXRGQGTQVTVSS

SEQ ID NO: 21 - protein, 102 aa, Artificial
  P,R,S 103-class Nanobody
  misc_feature (31)..(35): Xaa is any amino acid
  misc_feature (50)..(54): Xaa is any amino acid
  misc_feature (87)..(91): Xaa is any amino acid
DVQLVESGGDLVQPGGSLRLSCAASGFSFDXXXXXWLRQTPGKGLEWVGXXXXXRFTISRDNAKNMLYLHLNNLKSEDTAVYYCRRXXXXXLGQGTQVTVSS

SEQ ID NO: 22 - protein, 102 aa, Artificial; identical to SEQ ID NO: 18
  P,R,S 103-class Nanobody
  misc_feature (31)..(35): Xaa is any amino acid
  misc_feature (50)..(54): Xaa is any amino acid
  misc_feature (87)..(91): Xaa is any amino acid

SEQ ID NO: 23 - protein, 30 aa, Artificial
  KERE-class Nanobody FW1 sequence
QVQRVESGGGLVQAGGSLRLSCAASGRTSS

SEQ ID NO: 24 - protein, 30 aa, Artificial
  KERE-class Nanobody FW1 sequence
QVQLVESGGGLVQTGDSLSLSCSASGRTFS

SEQ ID NO: 25 - protein, 30 aa, Artificial
  KERE-class Nanobody FW1 sequence
QVKLEESGGGLVQAGDSLRLSCAATGRAFG

SEQ ID NO: 26 - protein, 30 aa, Artificial
  KERE-class Nanobody FW1 sequence
AVQLVESGGGLVQPGESLGLSCVASGRDFV

SEQ ID NO: 27 - protein, 30 aa, Artificial
  KERE-class Nanobody FW1 sequence
EVQLVESGGGLVQAGGSLRLSCEVLGRTAG

SEQ ID NO: 28 - protein, 30 aa, Artificial
  KERE-class Nanobody FW1 sequence
QVQLVESGGGWVQPGGSLRLSCAASETILS

SEQ ID NO: 29 - protein, 30 aa, Artificial
  KERE-class Nanobody FW1 sequence
QVQLVESGGGTVQPGGSLNLSCVASGNTFN

SEQ ID NO: 30 - protein, 30 aa, Artificial
  KERE-class Nanobody FW1 sequence
EVQLVESGGGLAQPGGSLQLSCSAPGFTLD

SEQ ID NO: 31 - protein, 30 aa, Artificial
  KERE-class Nanobody FW1 sequence
AQELEESGGGLVQAGGSLRLSCAASGRTFN

SEQ ID NO: 32 - protein, 22 aa, Artificial
  KERE-class Nanobody FW1 sequence
VESGGGLVQPGGSLRLSCAASG

SEQ ID NO: 33 - protein, 22 aa, Artificial
  KERE-class Nanobody FW1 sequence
VDSGGGLVQAGDSLKLSCALTG

SEQ ID NO: 34 - protein, 22 aa, Artificial
  KERE-class Nanobody FW1 sequence
VDSGGGLVQAGDSLRLSCAASG

SEQ ID NO: 35 - protein, 22 aa, Artificial
  KERE-class Nanobody FW1 sequence
VDSGGGLVEAGGSLRLSCQVSE

SEQ ID NO: 36 - protein, 22 aa, Artificial
  KERE-class Nanobody FW1 sequence
QDSGGGSVQAGGSLKLSCAASG

SEQ ID NO: 37 - protein, 22 aa, Artificial
  KERE-class Nanobody FW1 sequence
VQSGGRLVQAGDSLRLSCAASE

SEQ ID NO: 38 - protein, 22 aa, Artificial
  KERE-class Nanobody FW1 sequence
VESGGTLVQSGDSLKLSCASST

SEQ ID NO: 39 - protein, 22 aa, Artificial
  KERE-class Nanobody FW1 sequence
MESGGDSVQSGGSLTLSCVASG

SEQ ID NO: 40 - protein, 22 aa, Artificial
  KERE-class Nanobody FW1 sequence
QASGGGLVQAGGSLRLSCSASV

SEQ ID NO: 41 - protein, 14 aa, Artificial
  KERE-class Nanobody FW2 sequence
WFRQAPGKEREFVA

SEQ ID NO: 42 - protein, 14 aa, Artificial
  KERE-class Nanobody FW2 sequence
WFRQTPGREREFVA

SEQ ID NO: 43 - protein, 14 aa, Artificial
  KERE-class Nanobody FW2 sequence
WYRQAPGKQREMVA

SEQ ID NO: 44 - protein, 14 aa, Artificial
  KERE-class Nanobody FW2 sequence
WYRQGPGKQRELVA

SEQ ID NO: 45 - protein, 14 aa, Artificial
  KERE-class Nanobody FW2 sequence
WIRQAPGKEREGVS

SEQ ID NO: 46 - protein, 14 aa, Artificial
  KERE-class Nanobody FW2 sequence
WFREAPGKEREGIS

SEQ ID NO: 47 - protein, 14 aa, Artificial
  KERE-class Nanobody FW2 sequence
WYRQAPGKERDLVA

SEQ ID NO: 48 - protein, 14 aa, Artificial
  KERE-class Nanobody FW2 sequence
WFRQAPGKQREEVS

SEQ ID NO: 49 - protein, 14 aa, Artificial
  KERE-class Nanobody FW2 sequence
WFRQPPGKVREFVG

SEQ ID NO: 50 - protein, 32 aa, Artificial
  KERE-class Nanobody FW3 sequence
RFTISRDNAKNTVYLQMNSLKPEDTAVYRCYF

SEQ ID NO: 51 - protein, 32 aa, Artificial
  KERE-class Nanobody FW3 sequence
RFAISRDNNKNTGYLQMNSLEPEDTAVYYCAA

SEQ ID NO: 52 - protein, 32 aa, Artificial
  KERE-class Nanobody FW3 sequence
RFTVARNNAKNTVNLEMNSLKPEDTAVYYCAA

SEQ ID NO: 53 - protein, 32 aa, Artificial
  KERE-class Nanobody FW3 sequence
RFTISRDIAKNTVDLLMNNLEPEDTAVYYCAA

SEQ ID NO: 54 - protein, 32 aa, Artificial
  KERE-class Nanobody FW3 sequence
RLTISRDNAVDTMYLQMNSLKPEDTAVYYCAA

SEQ ID NO: 55 - protein, 32 aa, Artificial
  KERE-class Nanobody FW3 sequence
RFTISRDNAKNTVYLQMDNVKPEDTAIYYCAA

SEQ ID NO: 56 - protein, 32 aa, Artificial
  KERE-class Nanobody FW3 sequence
RFTISKDSGKNTVYLQMTSLKPEDTAVYYCAT

SEQ ID NO: 57 - protein, 32 aa, Artificial
  KERE-class Nanobody FW3 sequence
RFTISRDSAKNMMYLQMNNLKPQDTAVYYCAA

SEQ ID NO: 58 - protein, 32 aa, Artificial
  KERE-class Nanobody FW3 sequence
RFTISRENDKSTVYLQLNSLKPEDTAVYYCAA

SEQ ID NO: 59 - protein, 32 aa, Artificial
  KERE-class Nanobody FW3 sequence
RFTISRDYAGNTAYLQMNSLKPEDTGVYYCAT

SEQ ID NO: 60 - protein, 11 aa, Artificial
  KERE-class Nanobody FW4 sequence
WGQGTQVTVSS

SEQ ID NO: 61 - protein, 11 aa, Artificial
  KERE-class Nanobody FW4 sequence
WGKGTLVTVSS

SEQ ID NO: 62 - protein, 11 aa, Artificial
  KERE-class Nanobody FW4 sequence
RGQGTRVTVSS

SEQ ID NO: 63 - protein, 11 aa, Artificial
  KERE-class Nanobody FW4 sequence
WGLGTQVTISS

SEQ ID NO: 64 - protein, 30 aa, Artificial
  GLEW-class Nanobody FW1 sequence
QVQLVESGGGLVQPGGSLRLSCAASGFTFS

SEQ ID NO: 65 - protein, 30 aa, Artificial
  GLEW-class Nanobody FW1 sequence
EVHLVESGGGLVRPGGSLRLSCAAFGFIFK

SEQ ID NO: 66 - protein, 30 aa, Artificial
  GLEW-class Nanobody FW1 sequence
QVKLEESGGGLAQPGGSLRLSCVASGFTFS

SEQ ID NO: 67 - protein, 30 aa, Artificial
  GLEW-class Nanobody FW1 sequence
EVQLVESGGGLVQPGGSLRLSCVCVSSGCT

SEQ ID NO: 68 - protein, 30 aa, Artificial
  GLEW-class Nanobody FW1 sequence
EVQLVESGGGLALPGGSLTLSCVFSGSTFS

SEQ ID NO: 69 - protein, 22 aa, Artificial
  GLEW-class Nanobody FW1 sequence
VESGGGLVQPGGSLRLSCAASG

SEQ ID NO: 70 - protein, 22 aa, Artificial
  GLEW-class Nanobody FW1 sequence
EESGGGLAQPGGSLRLSCVASG

SEQ ID NO: 71 - protein, 22 aa, Artificial
  GLEW-class Nanobody FW1 sequence
VESGGGLALPGGSLTLSCVFSG

SEQ ID NO: 72 - protein, 14 aa, Artificial
  GLEW-class Nanobody FW2 sequence
WVRQAPGKVLEWVS

SEQ ID NO: 73 - protein, 14 aa, Artificial
  GLEW-class Nanobody FW2 sequence
WVRRPPGKGLEWVS

SEQ ID NO: 74 - protein, 14 aa, Artificial
  GLEW-class Nanobody FW2 sequence
WVRQAPGMGLEWVS

SEQ ID NO: 75 - protein, 14 aa, Artificial
  GLEW-class Nanobody FW2 sequence
WVRQAPGKEPEWVS

SEQ ID NO: 76 - protein, 14 aa, Artificial
  GLEW-class Nanobody FW2 sequence
WVRQAPGKDQEWVS

SEQ ID NO: 77 - protein, 14 aa, Artificial
  GLEW-class Nanobody FW2 sequence
WVRQAPGKAEEWVS

SEQ ID NO: 78 - protein, 14 aa, Artificial
  GLEW-class Nanobody FW2 sequence
WVRQAPGKGLEWVA

SEQ ID NO: 79 - protein, 14 aa, Artificial
  GLEW-class Nanobody FW2 sequence
WVRQAPGRATEWVS

SEQ ID NO: 80 - protein, 32 aa, Artificial
  GLEW-class Nanobody FW3 sequence
RFTISRDNAKNTLYLQMNSLKPEDTAVYYCVK

SEQ ID NO: 81 - protein, 32 aa, Artificial
  GLEW-class Nanobody FW3 sequence
RFTISRDNARNTLYLQMDSLIPEDTALYYCAR

SEQ ID NO: 82 - protein, 32 aa, Artificial
  GLEW-class Nanobody FW3 sequence
RFTSSRDNAKSTLYLQMNDLKPEDTALYYCAR

SEQ ID NO: 83 - protein, 32 aa, Artificial
  GLEW-class Nanobody FW3 sequence
RFIISRDNAKNTLYLQMNSLGPEDTAMYYCQR

SEQ ID NO: 84 - protein, 32 aa, Artificial
  GLEW-class Nanobody FW3 sequence
RFTASRDNAKNTLYLQMNSLKSEDTARYYCAR

SEQ ID NO: 85 - protein, 32 aa, Artificial
  GLEW-class Nanobody FW3 sequence
RFTISRDNAKNTLYLQMDDLQSEDTAMYYCGR

SEQ ID NO: 86 - protein, 11 aa, Artificial
  GLEW-class Nanobody FW4 sequence
GSQGTQVTVSS

SEQ ID NO: 87 - protein, 11 aa, Artificial
  GLEW-class Nanobody FW4 sequence
LRGGTQVTVSS

SEQ ID NO: 88 - protein, 11 aa, Artificial
  GLEW-class Nanobody FW4 sequence
RGQGTLVTVSS

SEQ ID NO: 89 - protein, 11 aa, Artificial
  GLEW-class Nanobody FW4 sequence
RSRGIQVTVSS

SEQ ID NO: 90 - protein, 11 aa, Artificial
  GLEW-class Nanobody FW4 sequence
WGKGTQVTVSS

SEQ ID NO: 91 - protein, 11 aa, Artificial
  GLEW-class Nanobody FW4 sequence
WGQGTQVTVSS

SEQ ID NO: 92 - protein, 30 aa, Artificial
  P,R,S 103-class Nanobody FW1 sequence
AVQLVESGGGLVQAGGSLRLSCAASGRTFS

SEQ ID NO: 93 - protein, 30 aa, Artificial
  P,R,S 103-class Nanobody FW1 sequence
QVQLQESGGGMVQPGGSLRLSCAASGFDFG

SEQ ID NO: 94 - protein, 30 aa, Artificial; identical to SEQ ID NO: 65
  P,R,S 103-class Nanobody FW1 sequence

SEQ ID NO: 95 - protein, 30 aa, Artificial
  P,R,S 103-class Nanobody FW1 sequence
QVQLAESGGGLVQPGGSLKLSCAASRTIVS

SEQ ID NO: 96 - protein, 30 aa, Artificial
  P,R,S 103-class Nanobody FW1 sequence
QEHLVESGGGLVDIGGSLRLSCAASERIFS

SEQ ID NO: 97 - protein, 30 aa, Artificial; identical to SEQ ID NO: 66
  P,R,S 103-class Nanobody FW1 sequence

SEQ ID NO: 98 - protein, 30 aa, Artificial; identical to SEQ ID NO: 67
  P,R,S 103-class Nanobody FW1 sequence

SEQ ID NO: 99 - protein, 30 aa, Artificial; identical to SEQ ID NO: 68
  P,R,S 103-class Nanobody FW1 sequence

SEQ ID NO: 100 - protein, 22 aa, Artificial
  P,R,S 103-class Nanobody FW1 sequence
VESGGGLVQAGGSLRLSCAASG

SEQ ID NO: 101 - protein, 22 aa, Artificial
  P,R,S 103-class Nanobody FW1 sequence
AESGGGLVQPGGSLKLSCAASR

SEQ ID NO: 102 - protein, 14 aa, Artificial
  P,R,S 103-class Nanobody FW2 sequence
WFRQAPGKEREFVA

SEQ ID NO: 103 - protein, 14 aa, Artificial
  P,R,S 103-class Nanobody FW2 sequence
WVRQAPGKVLEWVS

SEQ ID NO: 104 - protein, 14 aa, Artificial
  P,R,S 103-class Nanobody FW2 sequence
WVRRPPGKGLEWVS

SEQ ID NO: 105 - protein, 14 aa, Artificial
  P,R,S 103-class Nanobody FW2 sequence
WIRQAPGKEREGVS

SEQ ID NO: 106 - protein, 14 aa, Artificial
  P,R,S 103-class Nanobody FW2 sequence
WVRQYPGKEPEWVS

SEQ ID NO: 107 - protein, 14 aa, Artificial
  P,R,S 103-class Nanobody FW2 sequence
WFRQPPGKEHEFVA

SEQ ID NO: 108 - protein, 14 aa, Artificial
  P,R,S 103-class Nanobody FW2 sequence
WYRQAPGKRTELVA

SEQ ID NO: 109 - protein, 14 aa, Artificial
  P,R,S 103-class Nanobody FW2 sequence
WLRQAPGQGLEWVS

SEQ ID NO: 110 - protein, 14 aa, Artificial
  P,R,S 103-class Nanobody FW2 sequence
WLRQTPGKGLEWVG

SEQ ID NO: 111 - protein, 14 aa, Artificial
  P,R,S 103-class Nanobody FW2 sequence
WVRQAPGKAEEFVS

SEQ ID NO: 112 - protein, 32 aa, Artificial
  P,R,S 103-class Nanobody FW3 sequence
RFTISRDNAKNTVYLQMNSLKPEDTAVYYCAA

SEQ ID NO: 113 - protein, 32 aa, Artificial; identical to SEQ ID NO: 81
  P,R,S 103-class Nanobody FW3 sequence

SEQ ID NO: 114 - protein, 32 aa, Artificial
  P,R,S 103-class Nanobody FW3 sequence
RFTISRDNAKNEMYLQMNNLKTEDTGVYWCGA

SEQ ID NO: 115 - protein, 32 aa, Artificial
  P,R,S 103-class Nanobody FW3 sequence
RFTISSDSNRNMIYLQMNNLKPEDTAVYYCAA

SEQ ID NO: 116 - protein, 32 aa, Artificial
  P,R,S 103-class Nanobody FW3 sequence
RFTISRDNAKNMLYLHLNNLKSEDTAVYYCRR

SEQ ID NO: 117 - protein, 32 aa, Artificial
  P,R,S 103-class Nanobody FW3 sequence
RFTISRDNAKKTVYLRLNSLNPEDTAVYSCNL

SEQ ID NO: 118 - protein, 32 aa, Artificial
  P,R,S 103-class Nanobody FW3 sequence
RFKISRDNAKKTLYLQMNSLGPEDTAMYYCQR

SEQ ID NO: 119 - protein, 32 aa, Artificial
  P,R,S 103-class Nanobody FW3 sequence
RFTVSRDNGKNTAYLRMNSLKPEDTADYYCAV

SEQ ID NO: 120 - protein, 11 aa, Artificial
  P,R,S 103-class Nanobody FW4 sequence
RGQGTQVTVSS

SEQ ID NO: 121 - protein, 11 aa, Artificial
  P,R,S 103-class Nanobody FW4 sequence
LRGGTQVTVSS

SEQ ID NO: 122 - protein, 11 aa, Artificial
  P,R,S 103-class Nanobody FW4 sequence
GNKGTLVTVSS

SEQ ID NO: 123 - protein, 11 aa, Artificial
  P,R,S 103-class Nanobody FW4 sequence
SSPGTQVTVSS

SEQ ID NO: 124 - protein, 11 aa, Artificial
  P,R,S 103-class Nanobody FW4 sequence
SSQGTLVTVSS

SEQ ID NO: 125 - protein, 11 aa, Artificial
  P,R,S 103-class Nanobody FW4 sequence
RSRGIQVTVSS

SEQ ID NO: 126 - protein, 30 aa, Artificial
  FR1 sequence
EVQLVESGGGLVHPGGSLRLSCVGSGFSLD

SEQ ID NO: 127 - protein, 30 aa, Artificial
  FR1 sequence
EVQLVESGGGLVQPGGSLRLSCVGSGFSLD

SEQ ID NO: 128 - protein, 30 aa, Artificial
  FR1 sequence
EVQLVESGGGLVQPGGSLRLSCVASGFSLD

SEQ ID NO: 129 - protein, 30 aa, Artificial; identical to SEQ ID NO: 128
  FR1 sequence

SEQ ID NO: 130 - protein, 30 aa, Artificial; identical to SEQ ID NO: 128
  FR1 sequence

SEQ ID NO: 131 - protein, 30 aa, Artificial; identical to SEQ ID NO: 128
  FR1 sequence

SEQ ID NO: 132 - protein, 30 aa, Artificial; identical to SEQ ID NO: 128
  FR1 sequence

SEQ ID NO: 133 - protein, 30 aa, Artificial
  FR1 sequence
EVQLVESGGGLVQAGGSLRLSCVASKMTFM

SEQ ID NO: 134 - protein, 30 aa, Artificial
  FR1 sequence
EVQLMESGGGLVQPGGSLRLSCVASGFSLD

SEQ ID NO: 135 - protein, 30 aa, Artificial; identical to SEQ ID NO: 128
  FR1 sequence

SEQ ID NO: 136 - protein, 30 aa, Artificial; identical to SEQ ID NO: 128
  FR1 sequence

SEQ ID NO: 137 - protein, 30 aa, Artificial; identical to SEQ ID NO: 128
  FR1 sequence

SEQ ID NO: 138 - protein, 30 aa, Artificial; identical to SEQ ID NO: 128
  FR1 sequence

SEQ ID NO: 139 - protein, 30 aa, Artificial; identical to SEQ ID NO: 128
  FR1 sequence

SEQ ID NO: 140 - protein, 30 aa, Artificial; identical to SEQ ID NO: 128
  FR1 sequence

SEQ ID NO: 141 - protein, 30 aa, Artificial; identical to SEQ ID NO: 128
  FR1 sequence

SEQ ID NO: 142 - protein, 30 aa, Artificial; identical to SEQ ID NO: 128
  FR1 sequence

SEQ ID NO: 143 - protein, 30 aa, Artificial; identical to SEQ ID NO: 128
  FR1 sequence

SEQ ID NO: 144 - protein, 30 aa, Artificial; identical to SEQ ID NO: 128
  FR1 sequence

SEQ ID NO: 145 - protein, 30 aa, Artificial
  FR1 sequence
EVQLVESGGGLVQPGGSLKLSCVASGFSLD

SEQ ID NO: 146 - protein, 30 aa, Artificial; identical to SEQ ID NO: 128
  FR1 sequence

SEQ ID NO: 147 - protein, 30 aa, Artificial; identical to SEQ ID NO: 128
  FR1 sequence

SEQ ID NO: 148 - protein, 30 aa, Artificial; identical to SEQ ID NO: 128
  FR1 sequence

SEQ ID NO: 149 - protein, 30 aa, Artificial; identical to SEQ ID NO: 128
  FR1 sequence

SEQ ID NO: 150 - protein, 30 aa, Artificial; identical to SEQ ID NO: 128
  FR1 sequence

SEQ ID NO: 151 - protein, 30 aa, Artificial; identical to SEQ ID NO: 128
  FR1 sequence

SEQ ID NO: 152 - protein, 30 aa, Artificial; identical to SEQ ID NO: 128
  FR1 sequence

SEQ ID NO: 153 - protein, 30 aa, Artificial; identical to SEQ ID NO: 145
  FR1 sequence

SEQ ID NO: 154 - protein, 30 aa, Artificial
  FR1 sequence
EVQLVESGGGLVQPGGSLRLSCVASGFSLI

SEQ ID NO: 155 - protein, 30 aa, Artificial; identical to SEQ ID NO: 128
  FR1 sequence

SEQ ID NO: 156 - protein, 30 aa, Artificial; identical to SEQ ID NO: 127
  FR1 sequence

SEQ ID NO: 157 - protein, 30 aa, Artificial
  FR1 sequence
EVQLVESGGGLVQPGGSLRLSCAASGFIFD

SEQ ID NO: 158 - protein, 30 aa, Artificial; identical to SEQ ID NO: 157
  FR1 sequence

SEQ ID NO: 159 - protein, 30 aa, Artificial
  FR1 sequence
EVQLVESGGGLVQPGGSLKLSCAASGFIFD

SEQ ID NO: 160 - protein, 30 aa, Artificial
  FR1 sequence
EVQLVESGGGLVQPGGSLTLSCAGSGFIFD

SEQ ID NO: 161 - protein, 30 aa, Artificial
  FR1 sequence
EVQLVESGGSLVQPGGSLRLSCAASGFTFD

SEQ ID NO: 162 - protein, 30 aa, Artificial
  FR1 sequence
EVQLVESGGSLVQPGESLRLSCAASGFTFD

SEQ ID NO: 163 - protein, 30 aa, Artificial
  FR1 sequence
EVQLVESGGSLVPPGGSLRLSCAASGFTFD

SEQ ID NO: 164 - protein, 30 aa, Artificial; identical to SEQ ID NO: 161
  FR1 sequence

SEQ ID NO: 165 - protein, 30 aa, Artificial; identical to SEQ ID NO: 161
  FR1 sequence

SEQ ID NO: 166 - protein, 30 aa, Artificial
  FR1 sequence
EVQLVESGGSLVPPGGSLRLSCAVSGFTFD

SEQ ID NO: 167 - protein, 30 aa, Artificial; identical to SEQ ID NO: 161
  FR1 sequence

SEQ ID NO: 168 - protein, 30 aa, Artificial; identical to SEQ ID NO: 161
  FR1 sequence

SEQ ID NO: 169 - protein, 30 aa, Artificial; identical to SEQ ID NO: 161
  FR1 sequence

SEQ ID NO: 170 - protein, 30 aa, Artificial; identical to SEQ ID NO: 163
  FR1 sequence

SEQ ID NO: 171 - protein, 30 aa, Artificial; identical to SEQ ID NO: 161
  FR1 sequence

SEQ ID NO: 172 - protein, 30 aa, Artificial; identical to SEQ ID NO: 161
  FR1 sequence

SEQ ID NO: 173 - protein, 30 aa, Artificial; identical to SEQ ID NO: 163
  FR1 sequence

SEQ ID NO: 174 - protein, 30 aa, Artificial
  FR1 sequence
KVQLVESGGSLVPPGGSLRLSCAASGFTFD

SEQ ID NO: 175 - protein, 30 aa, Artificial; identical to SEQ ID NO: 163
  FR1 sequence

SEQ ID NO: 176 - protein, 30 aa, Artificial; identical to SEQ ID NO: 163
  FR1 sequence

SEQ ID NO: 177 - protein, 30 aa, Artificial; identical to SEQ ID NO: 161
  FR1 sequence

SEQ ID NO: 178 - protein, 30 aa, Artificial
  FR1 sequence
EVQLVESGGGLVQPGGSLRLSCATSGFTFD

SEQ ID NO: 179 - protein, 30 aa, Artificial
  FR1 sequence
EVQLVESGGSLVQPGGSLRLSCATSGFTFD

SEQ ID NO: 180 - protein, 30 aa, Artificial; identical to SEQ ID NO: 161
  FR1 sequence

SEQ ID NO: 181 - protein, 30 aa, Artificial; identical to SEQ ID NO: 161
  FR1 sequence

SEQ ID NO: 182 - protein, 30 aa, Artificial; identical to SEQ ID NO: 161
  FR1 sequence

SEQ ID NO: 183 - protein, 30 aa, Artificial; identical to SEQ ID NO: 161
  FR1 sequence

SEQ ID NO: 184 - protein, 30 aa, Artificial; identical to SEQ ID NO: 163
  FR1 sequence

SEQ ID NO: 185 - protein, 30 aa, Artificial; identical to SEQ ID NO: 161
  FR1 sequence

SEQ ID NO: 186 - protein, 30 aa, Artificial; identical to SEQ ID NO: 161
  FR1 sequence

SEQ ID NO: 187 - protein, 30 aa, Artificial
  FR1 sequence
EVQLVESGGGLVQAGGSLRLSCAASGITFS

SEQ ID NO: 188 - protein, 30 aa, Artificial
  FR1 sequence
EVQLVESGGGFVQTGGSPRLSCAASGRSFS

SEQ ID NO: 189 - protein, 30 aa, Artificial
  FR1 sequence
KVQLVESGGGLVQPGGSLRLSCAASGSIFG

SEQ ID NO: 190 - protein, 30 aa, Artificial
  FR1 sequence
EVQLVESGGGLVQAGGSLRLSCAASGSTFS

SEQ ID NO: 191 - protein, 30 aa, Artificial
  FR1 sequence
EVQLVESGGGLVQAGGSLRLSCAVNSRTFS

SEQ ID NO: 192 - protein, 30 aa, Artificial
  FR1 sequence
EVQLVESGGGLVQAGGSLRLSCAVSSRAFS

SEQ ID NO: 193 - protein, 30 aa, Artificial; identical to SEQ ID NO: 191
  FR1 sequence

SEQ ID NO: 194 - protein, 30 aa, Artificial; identical to SEQ ID NO: 192
  FR1 sequence

SEQ ID NO: 195 - protein, 30 aa, Artificial
  FR1 sequence
EVQLVESGGGSVQAGGSLRLSCVASEGTFS

SEQ ID NO: 196 - protein, 30 aa, Artificial
  FR1 sequence
EVQLVESGGGSVQAGSSLTLSCVASEGTFS

SEQ ID NO: 197 - protein, 30 aa, Artificial
  FR1 sequence
EVQLVESGGGLVQPGGSLTLSCVASEGTFS

SEQ ID NO: 198 - protein, 30 aa, Artificial
  FR1 sequence
EVQLVESGGGSVQAGGSLRLSCAASGSTFS

SEQ ID NO: 199 - protein, 30 aa, Artificial
  FR1 sequence
EVQLVKSGGGLVQAGGSLRLSCAASERTFS

SEQ ID NO: 200 - protein, 30 aa, Artificial
  FR1 sequence
EVQLVESGGGLVQAGGSLRLSCAASERTFS

SEQ ID NO: 201 - protein, 30 aa, Artificial
  FR1 sequence
EVQLVESGGGSVQAGGSLRLSCAASERTFS

SEQ ID NO: 202 - protein, 30 aa, Artificial
  FR1 sequence
EVQLVESGGGLVQAGGSLRLSCAANGLTFR

SEQ ID NO: 203 - protein, 30 aa, Artificial
  FR1 sequence
KVQLVESGGGLVQAGGSLRLSCAASGRTFT

SEQ ID NO: 204 - protein, 30 aa, Artificial
  FR1 sequence
EVQLVESGGGLVQAGGSLRLSCAASGFTFD

SEQ ID NO: 205 - protein, 30 aa, Artificial
  FR1 sequence
EVQLVESGGGLVQPGGSLRLSCAASGFAFS

SEQ ID NO: 206 - protein, 30 aa, Artificial
  FR1 sequence
EVQLVESGGGLVQAGGSLRLSCTASGRTSS

SEQ ID NO: 207 - protein, 30 aa, Artificial
  FR1 sequence
EVQLVESGGGLVQAGGSLRLSCVTSRRPAS

SEQ ID NO: 208 - protein, 30 aa, Artificial
  FR1 sequence
EVQLVESGGGLVQPGGSLRLSCAASRIPFS

SEQ ID NO: 209 - protein, 30 aa, Artificial; identical to SEQ ID NO: 207
  FR1 sequence

SEQ ID NO: 210 - protein, 30 aa, Artificial
  FR1 sequence
EVQLVESGGGLVQAGGSLRLSCVASRIPFS

SEQ ID NO: 211 - protein, 30 aa, Artificial; identical to SEQ ID NO: 207
  FR1 sequence

SEQ ID NO: 212 - protein, 30 aa, Artificial
  FR1 sequence
EVQLVESGGGLVQAGGSLNLSCVASGIPFS

SEQ ID NO: 213 - protein, 30 aa, Artificial; identical to SEQ ID NO: 212
  FR1 sequence

SEQ ID NO: 214 - protein, 30 aa, Artificial; identical to SEQ ID NO: 212
  FR1 sequence

SEQ ID NO: 215 - protein, 30 aa, Artificial
  FR1 sequence
EVQLVESGGGLVQPGGSLRLSCVASRIPAS

SEQ ID NO: 216 - protein, 30 aa, Artificial
  FR1 sequence
EVQLVESGGGLVQAGGSLRLSCVASRIPAS

SEQ ID NO: 217 - protein, 30 aa, Artificial; identical to SEQ ID NO: 215
  FR1 sequence

SEQ ID NO: 218 - protein, 30 aa, Artificial
  FR1 sequence
EVQLVESGGGLVQPGGSLKLSCVASTIPAS

SEQ ID NO: 219 - protein, 30 aa, Artificial
  FR1 sequence
EVQLVESGGGLVQAGGSLRLSCVASGIPFR

SEQ ID NO: 220 - protein, 30 aa, Artificial
  FR1 sequence
EVQLVESGGGLVQAGESLRLSCATSGITFK

SEQ ID NO: 221 - protein, 30 aa, Artificial
  FR1 sequence
EVQLMESGGGLVQAGGSLRLSCAANGLTFR

SEQ ID NO: 222 - protein, 30 aa, Artificial; identical to SEQ ID NO: 202
  FR1 sequence

SEQ ID NO: 223 - protein, 30 aa, Artificial
  FR1 sequence
EVQLVESGGGLVQPGGSLRLSCAASGLGIA

SEQ ID NO: 224 - protein, 30 aa, Artificial; identical to SEQ ID NO: 223
  FR1 sequence

SEQ ID NO: 225 - protein, 30 aa, Artificial
  FR1 sequence
EVQLVESGGGLVQAGGSLRLSCVASGIAQS

SEQ ID NO: 226 - protein, 30 aa, Artificial
  FR1 sequence
EVQLVESGGGLVQAGGSLRLSCAASGIAFR

SEQ ID NO: 227 - protein, 30 aa, Artificial
  FR1 sequence
EVQLVESGGGLVQAGGSLRLSCVASGIPSI

SEQ ID NO: 228 - protein, 30 aa, Artificial
  FR1 sequence
EVQLMESGGGLVQPGGSLRLSCAASGLGIA

SEQ ID NO: 229 - protein, 30 aa, Artificial; identical to SEQ ID NO: 226
  FR1 sequence

SEQ ID NO: 230 - protein, 30 aa, Artificial
  FR1 sequence
EVQLVESGGGLVQAGGSLRLSCVVSGIPSS

SEQ ID NO: 231 - protein, 30 aa, Artificial
  FR1 sequence
EVQLVESGGGSVQAGGSLRLSCVVSGIPSS

SEQ ID NO: 232 - protein, 30 aa, Artificial; identical to SEQ ID NO: 227
  FR1 sequence

SEQ ID NO: 233 - protein, 30 aa, Artificial
  FR1 sequence
EVQLVESGGGLVQPGGSLRLSCAASGIIGT

SEQ ID NO: 234 - protein, 30 aa, Artificial
  FR1 sequence
EVQLVESGGGLVQAGGSLRLPCAASGIAFR

SEQ ID NO: 235 - protein, 30 aa, Artificial; identical to SEQ ID NO: 226
  FR1 sequence

SEQ ID NO: 236 - protein, 30 aa, Artificial; identical to SEQ ID NO: 230
  FR1 sequence

SEQ ID NO: 237 - protein, 30 aa, Artificial
  FR1 sequence
EVQLVESGGGLVQAGGSLRLSCVVSGIPST

SEQ ID NO: 238 - protein, 30 aa, Artificial; identical to SEQ ID NO: 230
  FR1 sequence

SEQ ID NO: 239 - protein, 30 aa, Artificial
  FR1 sequence
EVQLVESGGGLVQAGGSLRLSCAASGRTFS

SEQ ID NO: 240 - protein, 30 aa, Artificial
  FR1 sequence
EVQLVESGGGLVQAGGSLRLSCAASGRAFK

SEQ ID NO: 241 - protein, 30 aa, Artificial
  FR1 sequence
EVQLVESGGGLVQTGGSLRLSCAASGSTFR

SEQ ID NO: 242 - protein, 30 aa, Artificial
  FR1 sequence
EVQLVESGGGLVQAGGSLKLSCVNSGIPST

SEQ ID NO: 243 - protein, 30 aa, Artificial
  FR1 sequence
EVQLVESGGGLVQPGGSLRLSCAASSVITL

SEQ ID NO: 244 - protein, 30 aa, Artificial
  FR1 sequence
EVQLVESGGGLVQAGGSLTLSCAASGSTSS

SEQ ID NO: 245 - protein, 30 aa, Artificial
  FR1 sequence
EVQLVESGGGLAQAGGSLSLSCAASGRFFS

SEQ ID NO: 246 - protein, 30 aa, Artificial
  FR1 sequence
EVQLVESGGGLVQAGGSLSLSCAASGRFFS

SEQ ID NO: 247 - protein, 30 aa, Artificial; identical to SEQ ID NO: 246
  FR1 sequence

SEQ ID NO: 248 - protein, 30 aa, Artificial
  FR1 sequence
EVQLVESGGGLVQAGGSLSLSCVASGRFFS

SEQ ID NO: 249 - protein, 30 aa, Artificial
  FR1 sequence
EVQLVESGGGLVQAGGSLSLSCSASGRFFS

SEQ ID NO: 250 - protein, 30 aa, Artificial
  FR1 sequence
EVQLVESGGGLVQAGGSLTLSCTASETTVR

SEQ ID NO: 251 - protein, 30 aa, Artificial
  FR1 sequence
EVQLVESGGGLVQAGGSLTLSCAPSESTVS

SEQ ID NO: 252 - protein, 30 aa, Artificial
  FR1 sequence
EVQLVESGGGLVQAGGSLRLSCAASGIISS

SEQ ID NO: 253 - protein, 30 aa, Artificial
  FR1 sequence
EVQLVESGGGLVQAGGSLRLSCVVSGVFGP

SEQ ID NO: 254 - protein, 30 aa, Artificial
  FR1 sequence
EVQLVESGGGLVQPGGSLRLSCAASGIGIA

SEQ ID NO: 255 - protein, 30 aa, Artificial
  FR1 sequence
EVQLVESGGGLVQPGGSLRLSCAASGIIGS

SEQ ID NO: 256 - protein, 30 aa, Artificial; identical to SEQ ID NO: 252
  FR1 sequence

SEQ ID NO: 257 - protein, 30 aa, Artificial; identical to SEQ ID NO: 223
  FR1 sequence

SEQ ID NO: 258 - protein, 30 aa, Artificial
  FR1 sequence
EVQLVESGGGLVQPGGSLRLSCAGSGFTFS

SEQ ID NO: 259 - protein, 30 aa, Artificial; identical to SEQ ID NO: 133
  FR1 sequence

SEQ ID NO: 260 - protein, 30 aa, Artificial; identical to SEQ ID NO: 133
  FR1 sequence

SEQ ID NO: 261 - protein, 30 aa, Artificial
  FR1 sequence
EVQLVESGGGLVQAGGSLRLSCVASKITFR

SEQ ID NO: 262 - protein, 30 aa, Artificial
  FR1 sequence
EVQLVESGGGLVQAGGSLKLSCVASGITFF

SEQ ID NO: 263 - protein, 30 aa, Artificial
  FR1 sequence
EVQLVESGGGLVQAGGSLRLSCAASGITFR

SEQ ID NO: 264 - protein, 30 aa, Artificial
  FR1 sequence
EVQLVESGGGLVQAGGSLRLSCAASASIFG

SEQ ID NO: 265 - protein, 30 aa, Artificial
  FR1 sequence
EVQLVESGGGLVQAGGSLRLSCAASGNIFS

SEQ ID NO: 266 - protein, 30 aa, Artificial
  FR1 sequence
EVQLVESGGGLVQAGDSLRLSCAASGRALD

SEQ ID NO: 267 - protein, 30 aa, Artificial
  FR1 sequence
EVQLVESGGGLVQPGGSLRLSCAASGFTFD

SEQ ID NO: 268 - protein, 30 aa, Artificial
  FR1 sequence
EVQLVESGGGLVQPGGSLKLSCAASGFTFS

SEQ ID NO: 269 - protein, 30 aa, Artificial; identical to SEQ ID NO: 190
  FR1 sequence

SEQ ID NO: 270 - protein, 30 aa, Artificial; identical to SEQ ID NO: 190
  FR1 sequence

SEQ ID NO: 271 - protein, 30 aa, Artificial
  FR1 sequence
EVQLVESGGGLVQAGGSLSLSCAASATLHR

SEQ ID NO: 272 - protein, 30 aa, Artificial
  FR1 sequence
EVQLVESGGGLVQPGGSLRLSCAASGFTFS

SEQ ID NO: 273 - protein, 30 aa, Artificial; identical to SEQ ID NO: 272
  FR1 sequence

SEQ ID NO: 274 - protein, 30 aa, Artificial
  FR1 sequence
EVQLVESGGGLVQPGGSLRLSCAASGFTLD

SEQ ID NO: 275 - protein, 30 aa, Artificial; identical to SEQ ID NO: 157
  FR1 sequence

SEQ ID NO: 276 - protein, 30 aa, Artificial; identical to SEQ ID NO: 250
  FR1 sequence

SEQ ID NO: 277 - protein, 30 aa, Artificial; identical to SEQ ID NO: 250
  FR1 sequence

SEQ ID NO: 278 - protein, 30 aa, Artificial; identical to SEQ ID NO: 250
  FR1 sequence

SEQ ID NO: 279 - protein, 30 aa, Artificial; identical to SEQ ID NO: 250
  FR1 sequence

SEQ ID NO: 280 - protein, 30 aa, Artificial
  FR1 sequence
EVQLVESGGGLVQPGGSLRLSCAASGRIFY

SEQ ID NO: 281 - protein, 30 aa, Artificial; identical to SEQ ID NO: 267
  FR1 sequence

SEQ ID NO: 282 - protein, 30 aa, Artificial
  FR1 sequence
EVQLVESGGGLVQAGGSLRLSCAASGRTFN

SEQ ID NO: 283 - protein, 30 aa, Artificial; identical to SEQ ID NO: 239
  FR1 sequence

SEQ ID NO: 284 - protein, 30 aa, Artificial
  FR1 sequence
KVQLVESGGGLVQAGGSLRLSCAASGRTFS

SEQ ID NO: 285 - protein, 30 aa, Artificial; identical to SEQ ID NO: 239
  FR1 sequence

SEQ ID NO: 286 - protein, 30 aa, Artificial; identical to SEQ ID NO: 239
  FR1 sequence

SEQ ID NO: 287 - protein, 30 aa, Artificial
  FR1 sequence
EVQLVESGGGLVQAGGSLRLSCVASGRTFS

SEQ ID NO: 288 - protein, 30 aa, Artificial; identical to SEQ ID NO: 239
  FR1 sequence

SEQ ID NO: 289 - protein, 30 aa, Artificial; identical to SEQ ID NO: 239
  FR1 sequence

SEQ ID NO: 290 - protein, 30 aa, Artificial
  FR1 sequence
EVQLVESGGGLVQAGGSLRLSCEASGLTIS

SEQ ID NO: 291 - protein, 30 aa, Artificial
  FR1 sequence
EVQLVESGGGLVQPGGSLRLSCAASGSAFS

SEQ ID NO: 292 - protein, 30 aa, Artificial
  FR1 sequence
EVQLVESGGGLVQAGGSLGLSCAAAGRTFS

SEQ ID NO: 293 - protein, 30 aa, Artificial
  FR1 sequence
EVQLVESGGGLVQAGGSLRLSCAASGRAFS

SEQ ID NO: 294 - protein, 30 aa, Artificial
  FR1 sequence
EVQLVESGGGLVQAGGSLRLSCATSGRTFS

SEQ ID NO: 295 - protein, 30 aa, Artificial
  FR1 sequence
EVQLVESGGGLVQPGGSLRLSCAASGNIDG

SEQ ID NO: 296 - protein, 30 aa, Artificial
  FR1 sequence
EVQLVESGGGLVQTGGSLRLSCAASGPTFS

SEQ ID NO: 297 - protein, 30 aa, Artificial
  FR1 sequence
EVQLVESGGGLVQAGDSLRLSCAASGFTFS

SEQ ID NO: 298 - protein, 30 aa, Artificial
  FR1 sequence
EVQLVESGGGLVQAGSSLRLSCALSGRTFS

SEQ ID NO: 299 - protein, 30 aa, Artificial
  FR1 sequence
EVQLVESGGGLVQAGGSLRLSCIASERTFS

SEQ ID NO: 300 - protein, 30 aa, Artificial
  FR1 sequence
EVQLVESGGGLVQPGDSLRLSCSASEGTLS

SEQ ID NO: 301 - protein, 30 aa, Artificial
  FR1 sequence
EVQLVESGGGLVQPGGSLTLSCVGSGRRFS

SEQ ID NO: 302 - protein, 30 aa, Artificial
  FR1 sequence
EVQLVESGGGLVQPGGSLPLSCAASGSIFR

SEQ ID NO: 303 - protein, 30 aa, Artificial
  FR1 sequence
EVQLVESGGGLAQAGGSLRLSCAVFGRSRY

SEQ ID NO: 304 - protein, 30 aa, Artificial
  FR1 sequence
EVQLVESGGGQVQAGGSLRLSCTESGRAFN

SEQ ID NO: 305 - protein, 30 aa, Artificial
  FR1 sequence
EVQLVESGGGLVQAGGSLGLSCAASGRTFS

SEQ ID NO: 306 - protein, 30 aa, Artificial
  FR1 sequence
EVQLVESGGGLVQAGDSLRLSCVASGGTFG

SEQ ID NO: 307 - protein, 30 aa, Artificial
  FR1 sequence
EVQLVESGGGLAQAGDSLRLSCVDSGSSFS

SEQ ID NO: 308 - protein, 30 aa, Artificial
  FR1 sequence
EVQLVESGGGLVQAGGSLRLSCAVSGGTFE

SEQ ID NO: 309 - protein, 30 aa, Artificial; identical to SEQ ID NO: 239
  FR1 sequence

SEQ ID NO: 310 - protein, 30 aa, Artificial
  FR1 sequence
EVQLVESGGGLVQAGDSLRLSCVASGDSFN

SEQ ID NO: 311 - protein, 30 aa, Artificial
  FR1 sequence
EVQLVESGGGLVQAGGSLRLSCVVSEGTFS

SEQ ID NO: 312 - protein, 30 aa, Artificial
  FR1 sequence
EAQLVESGGGLVQAGGSLRLSCTASGRTYS

SEQ ID NO: 313 - protein, 30 aa, Artificial; identical to SEQ ID NO: 293
  FR1 sequence

SEQ ID NO: 314 - protein, 30 aa, Artificial
  FR1 sequence
EVQLVESGGGLVQAGGSLRLSCAASGGTFS

SEQ ID NO: 315 - protein, 30 aa, Artificial
  FR1 sequence
EVQLVESGGGLVQAGGSLRLSCAASGGAFG

SEQ ID NO: 316 - protein, 30 aa, Artificial
  FR1 sequence
EVQLVESGGGLVQAGGSLRLSCAASGGTFG

SEQ ID NO: 317 - protein, 30 aa, Artificial
  FR1 sequence
EVQLVESGGGLVQAGGSLELSCAASGGAFG

SEQ ID NO: 318 - protein, 30 aa, Artificial; identical to SEQ ID NO: 316
  FR1 sequence

SEQ ID NO: 319 - protein, 30 aa, Artificial; identical to SEQ ID NO: 316
  FR1 sequence

SEQ ID NO: 320 - protein, 30 aa, Artificial
  FR1 sequence
EVQLVESGGGLVQAGGSLKLSCAVSGRTIV

SEQ ID NO: 321 - protein, 30 aa, Artificial; identical to SEQ ID NO: 272
  FR1 sequence

SEQ ID NO: 322 - protein, 30 aa, Artificial; identical to SEQ ID NO: 314
  FR1 sequence

SEQ ID NO: 323 - protein, 30 aa, Artificial
  FR1 sequence
EVQLVESGGGLVQAGGSLRLSCAASRHTFS

SEQ ID NO: 324 - protein, 30 aa, Artificial
  FR1 sequence
EVQLVESGGGLVQTGGSLRLSCAASGRAFS

SEQ ID NO: 325 - protein, 30 aa, Artificial
  FR1 sequence
EVQLVESGGGLVQAGGSLRLSCAASGRSFN

SEQ ID NO: 326 - protein, 30 aa, Artificial
  FR1 sequence
EVQLVESGGGLVRAGTSLRLSCADSARTFS

SEQ ID NO: 327 - protein, 30 aa, Artificial
  FR1 sequence
EVQLVESGGGLVQPGGSLRLSCTVFGRTFS

SEQ ID NO: 328 - protein, 30 aa, Artificial
  FR1 sequence
EVQLVESGGGLVQAGGSLGLSCAASGRTVS

SEQ ID NO: 329 - protein, 30 aa, Artificial
  FR1 sequence
EVQLVESGGGLVQAGGSLRLSCVASGRTLS

SEQ ID NO: 330 - protein, 30 aa, Artificial; identical to SEQ ID NO: 329
  FR1 sequence

SEQ ID NO: 331 - protein, 30 aa, Artificial; identical to SEQ ID NO: 239
  FR1 sequence

SEQ ID NO: 332 - protein, 30 aa, Artificial; identical to SEQ ID NO: 329
  FR1 sequence

SEQ ID NO: 333 - protein, 30 aa, Artificial
  FR1 sequence
EVQLVESGGGLVQAGGSLRLSCVRSGGYFG

SEQ ID NO: 334 - protein, 30 aa, Artificial
  FR1 sequence
EVQLVESGGGLVQPGGSLRLSCAASGSIFS

SEQ ID NO: 335 - protein, 30 aa, Artificial
  FR1 sequence
EMQLVESGGGLVQAGGSLRLSCATSERTFS

SEQ ID NO: 336 - protein, 30 aa, Artificial
  FR1 sequence
EVQLVESGGGLVQPGGSLRLSCAASRSIFS

SEQ ID NO: 337 - protein, 30 aa, Artificial; identical to SEQ ID NO: 314
  FR1 sequence

SEQ ID NO: 338 - protein, 30 aa, Artificial
  FR1 sequence
EVQLVESGGGLVQAGGSLRLSCAVSGFLFD

SEQ ID NO: 339 - protein, 30 aa, Artificial
  FR1 sequence
EVQLVESGGGLVQPGGSLRLSCAASRSIRS

SEQ ID NO: 340 - protein, 30 aa, Artificial
  FR1 sequence
EVQLVESGGALVQPGGSLRLSCAASGSIRS

SEQ ID NO: 341 - protein, 30 aa, Artificial
  FR1 sequence
EVQLVESGGALVQPGGSLRLSCAASDSIRS

SEQ ID NO: 342 - protein, 30 aa, Artificial
  FR1 sequence
EVQLVESGGGLVQPGGSLRLSCAASGSSAS

SEQ ID NO: 343 - protein, 30 aa, Artificial
  FR1 sequence
EVQLVESGGGLVQPGGSLRLSCAASRNIFD

SEQ ID NO: 344 - protein, 30 aa, Artificial; identical to SEQ ID NO: 314
  FR1 sequence

SEQ ID NO: 345 - protein, 30 aa, Artificial
  FR1 sequence
EVQLVESGGGLVQAGGSLSLSCAASGGTFN

SEQ ID NO: 346 - protein, 30 aa, Artificial
  FR1 sequence
EVQLVESGGGLVQAGGSLRLSCAISGRTLS

SEQ ID NO: 347 - protein, 30 aa, Artificial
  FR1 sequence
EVQLVESGGGLVQAGGSLRLSCAVSGRTFN

SEQ ID NO: 348 - protein, 30 aa, Artificial
  FR1 sequence
EVQLVESGGGLVRPGGSLRLSCATSGSDIG

SEQ ID NO: 349 - protein, 30 aa, Artificial
  FR1 sequence
EVQLVESGGGLVQAGGSLRLSCAASGRALI

SEQ ID NO: 350 - protein, 30 aa, Artificial
  FR1 sequence
EVQLVESGGGVVQAGGSLRLSCAPSGRTFS

SEQ ID NO: 351 - protein, 30 aa, Artificial
  FR1 sequence
EVQLVESGGGLVQAGGSLRLSCAPSGRTFS

SEQ ID NO: 352 - protein, 30 aa, Artificial
  FR1 sequence
EVQLVESGGGLVQAGGSLRLSCAASGRPVN

SEQ ID NO: 353 - protein, 30 aa, Artificial; identical to SEQ ID NO: 239
  FR1 sequence

SEQ ID NO: 354 - protein, 30 aa, Artificial
  FR1 sequence
EVQLVESGGGLVQAGGSLRLSCAASGRTYN

SEQ ID NO: 355 - protein, 30 aa, Artificial
  FR1 sequence
EVQLVESGGGLVQAGGSLRLSCTASGQTFN

SEQ ID NO: 356 - protein, 30 aa, Artificial
  FR1 sequence
EVQLVESGGAFVQPGGSLRLSCAASGSDVW

SEQ ID NO: 357 - protein, 30 aa, Artificial
  FR1 sequence
EVQLVESGGGLVQAGGSLRLSCTASGRAFN

SEQ ID NO: 358 - protein, 30 aa, Artificial
  FR1 sequence
EVQLVESGGGLVQAGGSLRLSCQLSGGTVS

SEQ ID NO: 359 - protein, 30 aa, Artificial
  FR1 sequence
EVQLVESGGGLVQAGGSLRLSCAASGSIFR

SEQ ID NO: 360 - protein, 30 aa, Artificial
  FR1 sequence
EVQLVESGGGLVQPGGSLRLSCAGSGNIVR

SEQ ID NO: 361 - protein, 30 aa, Artificial; identical to SEQ ID NO: 239
  FR1 sequence

SEQ ID NO: 362 - protein, 30 aa, Artificial
  FR1 sequence
EVQLVESGGGLVQAGGSLRLSCAASGRTFE

SEQ ID NO: 363 - protein, 30 aa, Artificial
  FR1 sequence
EVQLVESGGDLVQPGESLRLSCAVSGVTVD

SEQ ID NO: 364 - protein, 30 aa, Artificial
  FR1 sequence
EVQLVESGGGLVQAGASLRLSCAASGRTFS

SEQ ID NO: 365 - protein, 30 aa, Artificial
  FR1 sequence
EVQLVESGGGLVQTGGSLRLSCAASGRTFS

SEQ ID NO: 366 - protein, 30 aa, Artificial; identical to SEQ ID NO: 239
  FR1 sequence

SEQ ID NO: 367 - protein, 30 aa, Artificial
  FR1 sequence
EVQLVESGGGLVQAGGSLRLSCAVSGLTFS

SEQ ID NO: 368 - protein, 30 aa, Artificial; identical to SEQ ID NO: 367
  FR1 sequence

SEQ ID NO: 369 - protein, 30 aa, Artificial
  FR1 sequence
EVQLVESGGGLVQPGGSLRLSCAASGITFR

SEQ ID NO: 370 - protein, 30 aa, Artificial
  FR1 sequence
EVQLVESGGGLVQAGGSLRLSCTASGGTFG

SEQ ID NO: 371 - protein, 30 aa, Artificial
  FR1 sequence
EVQLVESGGGLVQAGGSLRLSCAASEPTFS

SEQ ID NO: 372 - protein, 30 aa, Artificial
  FR1 sequence
EVQLVESGGGLVQAGGSLRLSCVASGRTSS

SEQ ID NO: 373 - protein, 30 aa, Artificial
  FR1 sequence
EVQLVESGGGLVQAGGSLSLSCAASGRTFS

SEQ ID NO: 374 - protein, 30 aa, Artificial; identical to SEQ ID NO: 239
  FR1 sequence

SEQ ID NO: 375 - protein, 30 aa, Artificial
  FR1 sequence
EVQLVESGGGLVQPGGSLRLSCAASGSSLS

SEQ ID NO: 376 - protein, 30 aa, Artificial
  FR1 sequence
EVQLVESGGGLVQAGGSLRLSCAASGRALS

SEQ ID NO: 377 - protein, 30 aa, Artificial; identical to SEQ ID NO: 349
  FR1 sequence

SEQ ID NO: 378 - protein, 30 aa, Artificial
  FR1 sequence
EVQLVESGGGLVQAGGSLRLSCAASGRTSS

SEQ ID NO: 379 - protein, 30 aa, Artificial
  FR1 sequence
EVQLVESGGGLVQPGGSLRLSCAHSGRAFS

SEQ ID NO: 380 - protein, 30 aa, Artificial; identical to SEQ ID NO: 239
  FR1 sequence

SEQ ID NO: 381 - protein, 30 aa, Artificial
  FR1 sequence
EVQLVESGGGLVQAGGSLRLSCAASGGIFS

SEQ ID NO: 382 - protein, 30 aa, Artificial
  FR1 sequence
EVQLVESGGGLVQAGGSLRLSCAASGRIFS

SEQ ID NO: 383 - protein, 30 aa, Artificial
  FR1 sequence
EVQLVESGGGLVQAGGSLRLSCAASGRTFI

SEQ ID NO: 384 - protein, 30 aa, Artificial
  FR1 sequence
EVQLVESGGGLVQPGGSLRLSCAASGSIDS

SEQ ID NO: 385 - protein, 30 aa, Artificial
  FR1 sequence
EVQLVESGGGLVQSGGSLRLSCVASGTIVS

SEQ ID NO: 386 - protein, 30 aa, Artificial
  FR1 sequence
EVQLVESGGGMVQAGGSLRLSCAASGLTLS

SEQ ID NO: 387 - protein, 30 aa, Artificial; identical to SEQ ID NO: 383
  FR1 sequence

SEQ ID NO: 388 - protein, 30 aa, Artificial; identical to SEQ ID NO: 287
  FR1 sequence

SEQ ID NO: 389 - protein, 30 aa, Artificial
  FR1 sequence
EVQLVESGGGLVQDGGSLRLSCAASGQLAN

SEQ ID NO: 390 - protein, 30 aa, Artificial; identical to SEQ ID NO: 284
  FR1 sequence

SEQ ID NO: 391 - protein, 30 aa, Artificial
  FR1 sequence
EVQLVESGGGLVQAGGSLTLSCVISGLTLE

SEQ ID NO: 392 - protein, 30 aa, Artificial
  FR1 sequence
EVQLVESGGGLVQPGGSLRLSCAASGRTFS

SEQ ID NO: 393 - protein, 30 aa, Artificial
  FR1 sequence
EVQLVESGGGSVQPGGSLRLSCVASGSISS

SEQ ID NO: 394 - protein, 30 aa, Artificial; identical to SEQ ID NO: 393
  FR1 sequence

SEQ ID NO: 395 - protein, 30 aa, Artificial
  FR1 sequence
EVQLVESGGGLVQPGGSLRLSCAASGNIKS

SEQ ID NO: 396 - protein, 30 aa, Artificial
  FR1 sequence
EVQLVESGGGLVQAGGSLRLSCAASGFSFA

SEQ ID NO: 397 - protein, 30 aa, Artificial
  FR1 sequence
EVQLVESGGGLVQPGGSLRLSCAASGFPFG

SEQ ID NO: 398 - protein, 30 aa, Artificial
  FR1 sequence
EVQLVESGGGLEQAGGSLRLSCAASGLTFR

SEQ ID NO: 399 - protein, 30 aa, Artificial
  FR1 sequence
EVQLVESGGGLVQAGGSLRLSCAASGFSLD

SEQ ID NO: 400 - protein, 30 aa, Artificial
  FR1 sequence
EMQLVESGGGLVQPGGSLRLSCAASGNIPP

SEQ ID NO: 401 - protein, 5 aa, Artificial
  CDR1 sequence
DYGMT

SEQ ID NO: 402 - protein, 5 aa, Artificial
  CDR1 sequence
DYAMT

SEQ ID NO: 403 - protein, 5 aa, Artificial
  CDR1 sequence
DYGMT

SEQ ID NO: 404 - protein, 5 aa, Artificial
  CDR1 sequence
DYGMT

SEQ ID NO: 405 - protein, 5 aa, Artificial
  CDR1 sequence
DYGMT

SEQ ID NO: 406 - protein, 5 aa, Artificial
  CDR1 sequence
DYGMT

SEQ ID NO: 407 - protein, 5 aa, Artificial
  CDR1 sequence
DYGMT

SEQ ID NO: 408 - protein, 5 aa, Artificial
  CDR1 sequence
RYTMG

SEQ ID NO: 409 - protein, 5 aa, Artificial
  CDR1 sequence
DYGMT

SEQ ID NO: 410 - protein, 5 aa, Artificial
  CDR1 sequence
DYGMT

SEQ ID NO: 411 - protein, 5 aa, Artificial
  CDR1 sequence
DYGMT

SEQ ID NO: 412 - protein, 5 aa, Artificial
  CDR1 sequence
DYGMT

SEQ ID NO: 413 - protein, 5 aa, Artificial
  CDR1 sequence
DYAMT

SEQ ID NO: 414 - protein, 5 aa, Artificial
  CDR1 sequence
DYGMT

SEQ ID NO: 415 - protein, 5 aa, Artificial
  CDR1 sequence
DYGMT

SEQ ID NO: 416 - protein, 5 aa, Artificial
  CDR1 sequence
DYGMT

SEQ ID NO: 417 - protein, 5 aa, Artificial
  CDR1 sequence
DYGMT

SEQ ID NO: 418 - protein, 5 aa, Artificial
  CDR1 sequence
DYGMT

SEQ ID NO: 419 - protein, 5 aa, Artificial
  CDR1 sequence
DYGMT

SEQ ID NO: 420 - protein, 5 aa, Artificial
  CDR1 sequence
DYGMT

SEQ ID NO: 421 - protein, 5 aa, Artificial
  CDR1 sequence
DYGMT

SEQ ID NO: 422 - protein, 5 aa, Artificial
  CDR1 sequence
DYGMT

SEQ ID NO: 423 - protein, 5 aa, Artificial
  CDR1 sequence
DYGMT

SEQ ID NO: 424 - protein, 5 aa, Artificial
  CDR1 sequence
DYAMT

SEQ ID NO: 425 - protein, 5 aa, Artificial
  CDR1 sequence
DYAMT

SEQ ID NO: 426 - protein, 5 aa, Artificial
  CDR1 sequence
DYGMT

SEQ ID NO: 427 - protein, 5 aa, Artificial
  CDR1 sequence
DYGMT

SEQ ID NO: 428 - protein, 5 aa, Artificial
  CDR1 sequence
DYGMT

SEQ ID NO: 429 - protein, 5 aa, Artificial
  CDR1 sequence
NYAMT

SEQ ID NO: 430 - protein, 5 aa, Artificial
  CDR1 sequence
DYGMT

SEQ ID NO: 431 - protein, 5 aa, Artificial
  CDR1 sequence
DYAMT

SEQ ID NO: 432 - protein, 5 aa, Artificial
  CDR1 sequence
DYAMS

SEQ ID NO: 433 - protein, 5 aa, Artificial
  CDR1 sequence
DYAMS

SEQ ID NO: 434 - protein, 5 aa, Artificial
  CDR1 sequence
DYAMS

SEQ ID NO: 435 - protein, 5 aa, Artificial
  CDR1 sequence
DYAMS

SEQ ID NO: 436 - protein, 5 aa, Artificial
  CDR1 sequence
DYAMS

SEQ ID NO: 437 - protein, 5 aa, Artificial
  CDR1 sequence
DYAMS

SEQ ID NO: 438 - protein, 5 aa, Artificial
  CDR1 sequence
DYAMS

SEQ ID NO: 439 - protein, 5 aa, Artificial
  CDR1 sequence
DYAMS

SEQ ID NO: 440 - protein, 5 aa, Artificial
  CDR1 sequence
DYAMS

SEQ ID NO: 441 - protein, 5 aa, Artificial
  CDR1 sequence
DYAMS

SEQ ID NO: 442 - protein, 5 aa, Artificial
  CDR1 sequence
DYALS

SEQ ID NO: 443 - protein, 5 aa, Artificial
  CDR1 sequence
DYAMT

SEQ ID NO: 444 - protein, 5 aa, Artificial
  CDR1 sequence
DYAMT

SEQ ID NO: 445 - protein, 5 aa, Artificial
  CDR1 sequence
DYAMS

SEQ ID NO: 446 - protein, 5 aa, Artificial
  CDR1 sequence
DYAMT

SEQ ID NO: 447 - protein, 5 aa, Artificial
  CDR1 sequence
DYAMT

SEQ ID NO: 448 - protein, 5 aa, Artificial
  CDR1 sequence
DYAMS

SEQ ID NO: 449 - protein, 5 aa, Artificial
  CDR1 sequence
DYAMT

SEQ ID NO: 450 - protein, 5 aa, Artificial
  CDR1 sequence
DYAMS

SEQ ID NO: 451 - protein, 5 aa, Artificial
  CDR1 sequence
DYGMS

SEQ ID NO: 452 - protein, 5 aa, Artificial
  CDR1 sequence
DYAMT

SEQ ID NO: 453 - protein, 5 aa, Artificial
  CDR1 sequence
DYAMT

SEQ ID NO: 454 - protein, 5 aa, Artificial
  CDR1 sequence
DYAMT

SEQ ID NO: 455 - protein, 5 aa, Artificial
  CDR1 sequence
DYAMT

SEQ ID NO: 456 - protein, 5 aa, Artificial
  CDR1 sequence
DYAMT

SEQ ID NO: 457 - protein, 5 aa, Artificial
  CDR1 sequence
DYAMT

SEQ ID NO: 458 - protein, 5 aa, Artificial
  CDR1 sequence
DYAMT

SEQ ID NO: 459 - protein, 5 aa, Artificial
  CDR1 sequence
DYGMS

SEQ ID NO: 460 - protein, 5 aa, Artificial
  CDR1 sequence
DYAMT

SEQ ID NO: 461 - protein, 5 aa, Artificial
  CDR1 sequence
DYAMS

SEQ ID NO: 462 - protein, 5 aa, Artificial
  CDR1 sequence
INTMG

SEQ ID NO: 463 - protein, 5 aa, Artificial
  CDR1 sequence
EYAAA

SEQ ID NO: 464 - protein, 5 aa, Artificial
  CDR1 sequence
FNDMA

SEQ ID NO: 465 - protein, 5 aa, Artificial
  CDR1 sequence
SYGMG

SEQ ID NO: 466 - protein, 5 aa, Artificial
  CDR1 sequence
SYGMG

SEQ ID NO: 467 - protein, 5 aa, Artificial
  CDR1 sequence
SYGMG

SEQ ID NO: 468 - protein, 5 aa, Artificial
  CDR1 sequence
SYGMG

SEQ ID NO: 469 - protein, 5 aa, Artificial
  CDR1 sequence
SYGMG

SEQ ID NO: 470 - protein, 5 aa, Artificial
  CDR1 sequence
SYGMG

SEQ ID NO: 471 - protein, 5 aa, Artificial
  CDR1 sequence
SYGMG

SEQ ID NO: 472 - protein, 5 aa, Artificial
  CDR1 sequence
SYGMG

SEQ ID NO: 473 - protein, 5 aa, Artificial
  CDR1 sequence
SYGMG

SEQ ID NO: 474 - protein, 5 aa, Artificial
  CDR1 sequence
SYGMG

SEQ ID NO: 475 - protein, 5 aa, Artificial
  CDR1 sequence
SYGMG

SEQ ID NO: 476 - protein, 5 aa, Artificial
  CDR1 sequence
SYGMG

SEQ ID NO: 477 - protein, 5 aa, Artificial
  CDR1 sequence
RYDMG

SEQ ID NO: 478 - protein, 5 aa, Artificial
  CDR1 sequence
EYSMG

SEQ ID NO: 479 - protein, 5 aa, Artificial
  CDR1 sequence
DYGIG

SEQ ID NO: 480 - protein, 5 aa, Artificial
  CDR1 sequence
SYAMS

SEQ ID NO: 481 - protein, 5 aa, Artificial
  CDR1 sequence
TSAMG

SEQ ID NO: 482 - protein, 5 aa, Artificial
  CDR1 sequence
TRTMA

SEQ ID NO: 483 - protein, 5 aa, Artificial
  CDR1 sequence
TRTMA

SEQ ID NO: 484 - protein, 5 aa, Artificial
  CDR1 sequence
TRTMA

SEQ ID NO: 485 - protein, 5 aa, Artificial
  CDR1 sequence
SRTMA

SEQ ID NO: 486 - protein, 5 aa, Artificial
  CDR1 sequence
TRTMA

SEQ ID NO: 487 - protein, 5 aa, Artificial
  CDR1 sequence
TRTMA

SEQ ID NO: 488 - protein, 5 aa, Artificial
  CDR1 sequence
TRTMA

SEQ ID NO: 489 - protein, 5 aa, Artificial
  CDR1 sequence
TRTMA

SEQ ID NO: 490 - protein, 5 aa, Artificial
  CDR1 sequence
IRTMA

SEQ ID NO: 491 - protein, 5 aa, Artificial
  CDR1 sequence
IRTMA

SEQ ID NO: 492 - protein, 5 aa, Artificial
  CDR1 sequence
IRTMA

SEQ ID NO: 493 - protein, 5 aa, Artificial
  CDR1 sequence
IRTMA

SEQ ID NO: 494 - protein, 5 aa, Artificial
  CDR1 sequence
SRTMA

SEQ ID NO: 495 - protein, 5 aa, Artificial
  CDR1 sequence
RYVMG

SEQ ID NO: 496 - protein, 5 aa, Artificial
  CDR1 sequence
RYDMG

SEQ ID NO: 497 - protein, 5 aa, Artificial
  CDR1 sequence
RYDMG

SEQ ID NO: 498 - protein, 7 aa, Artificial
  CDR1 sequence
FSRRTMA

SEQ ID NO: 499 - protein, 7 aa, Artificial
  CDR1 sequence
FSRRTMA

SEQ ID NO: 500 - protein, 5 aa, Artificial
  CDR1 sequence
IRVMA

SEQ ID NO: 501 - protein, 5 aa, Artificial
  CDR1 sequence
IRTMA

SEQ ID NO: 502 - protein, 4 aa, Artificial
  CDR1 sequence
RAIA

SEQ ID NO: 503 - protein, 7 aa, Artificial
  CDR1 sequence
FSRRTMA

SEQ ID NO: 504 - protein, 5 aa, Artificial
  CDR1 sequence
IRTMA

SEQ ID NO: 505 - protein, 5 aa, Artificial
  CDR1 sequence
IRAMA

SEQ ID NO: 506 - protein, 5 aa, Artificial
  CDR1 sequence
IRAMA

SEQ ID NO: 507 - protein, 4 aa, Artificial
  CDR1 sequence
HAMA

SEQ ID NO: 508 - protein, 5 aa, Artificial
  CDR1 sequence
IRTMA

SEQ ID NO: 509 - protein, 5 aa, Artificial
  CDR1 sequence
IRTMA

SEQ ID NO: 510 - protein, 5 aa, Artificial
  CDR1 sequence
IRTMA

SEQ ID NO: 511 - protein, 5 aa, Artificial
  CDR1 sequence
IRAMA

SEQ ID NO: 512 - protein, 5 aa, Artificial
  CDR1 sequence
IRAMA

SEQ ID NO: 513 - protein, 5 aa, Artificial
  CDR1 sequence
IRAMA

SEQ ID NO: 514 - protein, 5 aa, Artificial
  CDR1 sequence
DDAMG

SEQ ID NO: 515 - protein, 5 aa, Artificial
  CDR1 sequence
DDAVG

SEQ ID NO: 516 - protein, 5 aa, Artificial
  CDR1 sequence
TDMMG

SEQ ID NO: 517 - protein, 5 aa, Artificial
  CDR1 sequence
LRAMA

SEQ ID NO: 518 - protein, 6 aa, Artificial
  CDR1 sequence
DSNAIG

SEQ ID NO: 519 - protein, 5 aa, Artificial
  CDR1 sequence
LDIMA

SEQ ID NO: 520 - protein, 5 aa, Artificial
  CDR1 sequence
TRVMA

SEQ ID NO: 521 - protein, 5 aa, Artificial
  CDR1 sequence
TRVMA

SEQ ID NO: 522 - protein, 5 aa, Artificial
  CDR1 sequence
TRVMA

SEQ ID NO: 523 - protein, 5 aa, Artificial
  CDR1 sequence
TRVMA

SEQ ID NO: 524 - protein, 5 aa, Artificial
  CDR1 sequence
TRVMA

SEQ ID NO: 525 - protein, 5 aa, Artificial
  CDR1 sequence
IRTMA

SEQ ID NO: 526 - protein, 5 aa, Artificial
  CDR1 sequence
FNTVA

SEQ ID NO: 527 - protein, 5 aa, Artificial
  CDR1 sequence
FRTMA

SEQ ID NO: 528 - protein, 5 aa, Artificial
  CDR1 sequence
IRAMA

SEQ ID NO: 529 - protein, 7 aa, Artificial
  CDR1 sequence
FSSRTMA

SEQ ID NO: 530 - protein, 5 aa, Artificial
  CDR1 sequence
FRTMA

SEQ ID NO: 531 - protein, 5 aa, Artificial
  CDR1 sequence
FRTLA

SEQ ID NO: 532 - protein, 7 aa, Artificial
  CDR1 sequence
FSRRTMA

SEQ ID NO: 533 - protein, 5 aa, Artificial
  CDR1 sequence
NYAMT

SEQ ID NO: 534 - protein, 5 aa, Artificial
  CDR1 sequence
RYTMG

SEQ ID NO: 535 - protein, 5 aa, Artificial
  CDR1 sequence
RYTMG

SEQ ID NO: 536 - protein, 5 aa, Artificial
  CDR1 sequence
RYIMD

SEQ ID NO: 537 - protein, 5 aa, Artificial
  CDR1 sequence
RYTMG

SEQ ID NO: 538 - protein, 5 aa, Artificial
  CDR1 sequence
RYDMG

SEQ ID NO: 539 - protein, 5 aa, Artificial
  CDR1 sequence
FDSMG

SEQ ID NO: 540 - protein, 5 aa, Artificial
  CDR1 sequence
HNAMG

SEQ ID NO: 541 - protein, 5 aa, Artificial
  CDR1 sequence
TYVMG

SEQ ID NO: 542 - protein, 5 aa, Artificial
  CDR1 sequence
DYSMS

SEQ ID NO: 543 - protein, 5 aa, Artificial
  CDR1 sequence
SYRMY

SEQ ID NO: 544 - protein, 5 aa, Artificial
  CDR1 sequence
INRMA

SEQ ID NO: 545 - protein, 5 aa, Artificial
  CDR1 sequence
INRWG

SEQ ID NO: 546 - protein, 4 aa, Artificial
  CDR1 sequence
FDNN

SEQ ID NO: 547 - protein, 5 aa, Artificial
  CDR1 sequence
SYAMS

SEQ ID NO: 548 - protein, 5 aa, Artificial
  CDR1 sequence
SYAMS

SEQ ID NO: 549 - protein, 5 aa, Artificial
  CDR1 sequence
YCAIG

SEQ ID NO: 550 - protein, 5 aa, Artificial
  CDR1 sequence
DYAMS

SEQ ID NO: 551 - protein, 5 aa, Artificial
  CDR1 sequence
IRTMA

SEQ ID NO: 552 - protein, 5 aa, Artificial
  CDR1 sequence
IRTMA

SEQ ID NO: 553 - protein, 5 aa, Artificial
  CDR1 sequence
IRTMA

SEQ ID NO: 554 - protein, 5 aa, Artificial
  CDR1 sequence
IRTMA

SEQ ID NO: 555 - protein, 3 aa, Artificial
  CDR1 sequence
PMG

SEQ ID NO: 556 - protein, 5 aa, Artificial
  CDR1 sequence
DYATS

SEQ ID NO: 557 - protein, 3 aa, Artificial
  CDR1 sequence
AMG

SEQ ID NO: 558 - protein, 5 aa, Artificial
  CDR1 sequence
SYAMA

SEQ ID NO: 559 - protein, 5 aa, Artificial
  CDR1 sequence
SYAMA

SEQ ID NO: 560 - protein, 5 aa, Artificial
  CDR1 sequence
SYAMA

SEQ ID NO: 561 - protein, 5 aa, Artificial
  CDR1 sequence
SYAMG

SEQ ID NO: 562 - protein, 5 aa, Artificial
  CDR1 sequence
NYALA

SEQ ID NO: 563 - protein, 5 aa, Artificial
  CDR1 sequence
RFAMG

SEQ ID NO: 564 - protein, 5 aa, Artificial
  CDR1 sequence
SYAMA

SEQ ID NO: 565 - protein, 5 aa, Artificial
  CDR1 sequence
SLTMA

SEQ ID NO: 566 - protein, 5 aa, Artificial
  CDR1 sequence
IKSMG

SEQ ID NO: 567 - protein, 5 aa, Artificial
  CDR1 sequence
SSLMG

SEQ ID NO: 568 - protein, 5 aa, Artificial
  CDR1 sequence
SYAMG

SEQ ID NO: 569 - protein, 6 aa, Artificial
  CDR1 sequence
TYASMG

SEQ ID NO: 570 - protein, 5 aa, Artificial
  CDR1 sequence
IITMG

SEQ ID NO: 571 - protein, 5 aa, Artificial
  CDR1 sequence
DYAIG

SEQ ID NO: 572 - protein, 5 aa, Artificial
  CDR1 sequence
NHIMG

SEQ ID NO: 573 - protein, 5 aa, Artificial
  CDR1 sequence
DYAIG

SEQ ID NO: 574 - protein, 5 aa, Artificial
  CDR1 sequence
SAGVG

SEQ ID NO: 575 - protein, 5 aa, Artificial
  CDR1 sequence
RSRVA

SEQ ID NO: 576 - protein, 5 aa, Artificial
  CDR1 sequence
ADVMG

SEQ ID NO: 577 - protein, 5 aa, Artificial
  CDR1 sequence
MNDMG

SEQ ID NO: 578 - protein, 3 aa, Artificial
  CDR1 sequence
GMA

SEQ ID NO: 579 - protein, 5 aa, Artificial
  CDR1 sequence
TRAMG

SEQ ID NO: 580 - protein, 5 aa, Artificial
  CDR1 sequence
NYAMG

SEQ ID NO: 581 - protein, 5 aa, Artificial
  CDR1 sequence
SYAMG

SEQ ID NO: 582 - protein, 5 aa, Artificial
  CDR1 sequence
AYAMG

SEQ ID NO: 583 - protein, 5 aa, Artificial
  CDR1 sequence
SDTMA

SEQ ID NO: 584 - protein, 5 aa, Artificial
  CDR1 sequence
SNAMA

SEQ ID NO: 585 - protein, 5 aa, Artificial
  CDR1 sequence
TYTMG

SEQ ID NO: 586 - protein, 5 aa, Artificial
  CDR1 sequence
SYSMG

SEQ ID NO: 587 - protein, 4 aa, Artificial
  CDR1 sequence
TTMG

SEQ ID NO: 588 - protein, 5 aa, Artificial
  CDR1 sequence
SYAMG

SEQ ID NO: 589 - protein, 5 aa, Artificial
  CDR1 sequence
VYHMA

SEQ ID NO: 590 - protein, 5 aa, Artificial
  CDR1 sequence
VYHMG

SEQ ID NO: 591 - protein, 5 aa, Artificial
  CDR1 sequence
VYHMG

SEQ ID NO: 592 - protein, 5 aa, Artificial
  CDR1 sequence
VYHMG

SEQ ID NO: 593 - protein, 5 aa, Artificial
  CDR1 sequence
VYTMA

SEQ ID NO: 594 - protein, 5 aa, Artificial
  CDR1 sequence
VYHMG

SEQ ID NO: 595 - protein, 5 aa, Artificial
  CDR1 sequence
PYTMA

SEQ ID NO: 596 - protein, 5 aa, Artificial
  CDR1 sequence
SYAMS

SEQ ID NO: 597 - protein, 5 aa, Artificial
  CDR1 sequence
SGVMA

SEQ ID NO: 598 - protein, 5 aa, Artificial
  CDR1 sequence
GYAMG

SEQ ID NO: 599 - protein, 5 aa, Artificial
  CDR1 sequence
TYGMG

SEQ ID NO: 600 - protein, 5 aa, Artificial
  CDR1 sequence
DYTMG

SEQ ID NO: 601 - protein, 5 aa, Artificial
  CDR1 sequence
SAAMG

SEQ ID NO: 602 - protein, 5 aa, Artificial
  CDR1 sequence
GDVIG

SEQ ID NO: 603 - protein, 3 aa, Artificial
  CDR1 sequence
TMG

SEQ ID NO: 604 - protein, 5 aa, Artificial
  CDR1 sequence
TTGVG

SEQ ID NO: 605 - protein, 5 aa, Artificial
  CDR1 sequence
TTGVG

SEQ ID NO: 606 - protein, 5 aa, Artificial
  CDR1 sequence
RDVMG

SEQ ID NO: 607 - protein, 5 aa, Artificial
  CDR1 sequence
TTGVG

SEQ ID NO: 608 - protein, 5 aa, Artificial
  CDR1 sequence
SYHIG

SEQ ID NO: 609 - protein, 5 aa, Artificial
  CDR1 sequence
INAMG

SEQ ID NO: 610 - protein, 5 aa, Artificial
  CDR1 sequence
TYTMA

SEQ ID NO: 611 - protein, 5 aa, Artificial
  CDR1 sequence
PNVVG

SEQ ID NO: 612 - protein, 5 aa, Artificial
  CDR1 sequence
RYKMG

SEQ ID NO: 613 - protein, 5 aa, Artificial
  CDR1 sequence
SYAMG

SEQ ID NO: 614 - protein, 5 aa, Artificial
  CDR1 sequence
VSVMG

SEQ ID NO: 615 - protein, 5 aa, Artificial
  CDR1 sequence
INTMG

SEQ ID NO: 616 - protein, 5 aa, Artificial
  CDR1 sequence
INIMG

SEQ ID NO: 617 - protein, 5 aa, Artificial
  CDR1 sequence
INTMG

SEQ ID NO: 618 - protein, 5 aa, Artificial
  CDR1 sequence
FNDMG

SEQ ID NO: 619 - protein, 5 aa, Artificial
  CDR1 sequence
GRGMG

SEQ ID NO: 620 - protein, 5 aa, Artificial
  CDR1 sequence
GRAVG

SEQ ID NO: 621 - protein, 5 aa, Artificial
  CDR1 sequence
GRAMG

SEQ ID NO: 622 - protein, 5 aa, Artificial
  CDR1 sequence
NDHMG

SEQ ID NO: 623 - protein, 5 aa, Artificial
  CDR1 sequence
INAMG

SEQ ID NO: 624 - protein, 5 aa, Artificial
  CDR1 sequence
NYAMG

SEQ ID NO: 625 - protein, 5 aa, Artificial
  CDR1 sequence
SYVMG

SEQ ID NO: 626 - protein, 5 aa, Artificial
  CDR1 sequence
SYVMG

SEQ ID NO: 627 - protein, 5 aa, Artificial
  CDR1 sequence
NYIMG

SEQ ID NO: 628 - protein, 5 aa, Artificial
  CDR1 sequence
AYAMG

SEQ ID NO: 629 - protein, 2 aa, Artificial
  CDR1 sequence
MA

SEQ ID NO: 630 - protein, 2 aa, Artificial
  CDR1 sequence
MG

SEQ ID NO: 631 - protein, 5 aa, Artificial
  CDR1 sequence
FNVMG

SEQ ID NO: 632 - protein, 2 aa, Artificial
  CDR1 sequence
MG

SEQ ID NO: 633 - protein, 5 aa, Artificial
  CDR1 sequence
DLHMG

SEQ ID NO: 634 - protein, 5 aa, Artificial
  CDR1 sequence
VNHMG

SEQ ID NO: 635 - protein, 5 aa, Artificial
  CDR1 sequence
DNTMA

SEQ ID NO: 636 - protein, 5 aa, Artificial
  CDR1 sequence
MYLMG

SEQ ID NO: 637 - protein, 5 aa, Artificial
  CDR1 sequence
RYAMG

SEQ ID NO: 638 - protein, 5 aa, Artificial
  CDR1 sequence
YSGIG

SEQ ID NO: 639 - protein, 5 aa, Artificial
  CDR1 sequence
RYDIG

SEQ ID NO: 640 - protein, 5 aa, Artificial
  CDR1 sequence
GSRMG

SEQ ID NO: 641 - protein, 5 aa, Artificial
  CDR1 sequence
GSRMG

SEQ ID NO: 642 - protein, 5 aa, Artificial
  CDR1 sequence
SYAMG

SEQ ID NO: 643 - protein, 5 aa, Artificial
  CDR1 sequence
TYAMG

SEQ ID NO: 644 - protein, 5 aa, Artificial
  CDR1 sequence
FKAMG

SEQ ID NO: 645 - protein, 5 aa, Artificial
  CDR1 sequence
SYALG

SEQ ID NO: 646 - protein, 5 aa, Artificial
  CDR1 sequence
SVAMG

SEQ ID NO: 647 - protein, 5 aa, Artificial
  CDR1 sequence
YYHMA

SEQ ID NO: 648 - protein, 5 aa, Artificial
  CDR1 sequence
NYRMA

SEQ ID NO: 649 - protein, 5 aa, Artificial
  CDR1 sequence
RYAMH

SEQ ID NO: 650 - protein, 5 aa, Artificial
  CDR1 sequence
FNAMG

SEQ ID NO: 651 - protein, 5 aa, Artificial
  CDR1 sequence
NYAMR

SEQ ID NO: 652 - protein, 5 aa, Artificial
  CDR1 sequence
SFAMR

SEQ ID NO: 653 - protein, 5 aa, Artificial
  CDR1 sequence
GYGMG

SEQ ID NO: 654 - protein, 5 aa, Artificial
  CDR1 sequence
LRTMG

SEQ ID NO: 655 - protein, 5 aa, Artificial
  CDR1 sequence
RYAMG

SEQ ID NO: 656 - protein, 5 aa, Artificial
  CDR1 sequence
SHAIS

SEQ ID NO: 657 - protein, 5 aa, Artificial
  CDR1 sequence
NYAWS

SEQ ID NO: 658 - protein, 5 aa, Artificial
  CDR1 sequence
SSPMG

SEQ ID NO: 659 - protein, 5 aa, Artificial
  CDR1 sequence
IHVVG

SEQ ID NO: 660 - protein, 5 aa, Artificial
  CDR1 sequence
INATS

SEQ ID NO: 661 - protein, 5 aa, Artificial
  CDR1 sequence
NYGMG

SEQ ID NO: 662 - protein, 6 aa, Artificial
  CDR1 sequence
SNYAMG

SEQ ID NO: 663 - protein, 5 aa, Artificial
  CDR1 sequence
GYSVG

SEQ ID NO: 664 - protein, 7 aa, Artificial
  CDR1 sequence
FASYAMG

SEQ ID NO: 665 - protein, 5 aa, Artificial
  CDR1 sequence
NYSVG

SEQ ID NO: 666 - protein, 5 aa, Artificial
  CDR1 sequence
SHAMG

SEQ ID NO: 667 - protein, 5 aa, Artificial
  CDR1 sequence
DLALG

SEQ ID NO: 668 - protein, 5 aa, Artificial
  CDR1 sequence
TNAMG

SEQ ID NO: 669 - protein, 5 aa, Artificial
  CDR1 sequence
VNAMG

SEQ ID NO: 670 - protein, 5 aa, Artificial
  CDR1 sequence
IDVMG

SEQ ID NO: 671 - protein, 5 aa, Artificial
  CDR1 sequence
DYAIG

SEQ ID NO: 672 - protein, 5 aa, Artificial
  CDR1 sequence
MYGMR

SEQ ID NO: 673 - protein, 5 aa, Artificial
  CDR1 sequence
SAAMG

SEQ ID NO: 674 - protein, 5 aa, Artificial
  CDR1 sequence
DRAIA

SEQ ID NO: 675 - protein, 5 aa, Artificial
  CDR1 sequence
INAMA

SEQ ID NO: 676 - protein, 14 aa, Artificial
  FR2 sequence
WVRRAPGKGLEWVS

SEQ ID NO: 677 - protein, 14 aa, Artificial
  FR2 sequence
WVRQAPGKGLEWVS

SEQ ID NO: 678 - protein, 14 aa, Artificial
  FR2 sequence
WVRQAPGKGLEWVS

SEQ ID NO: 679 - protein, 14 aa, Artificial
  FR2 sequence
WVRQAPGKGLEWVS

SEQ ID NO: 680 - protein, 14 aa, Artificial
  FR2 sequence
WVRQAPGKGLEWVS

SEQ ID NO: 681 - protein, 14 aa, Artificial
  FR2 sequence
WVRQAPGKGLEWVS

SEQ ID NO: 682 - protein, 14 aa, Artificial
  FR2 sequence
WVRQAPGKGLEWVS

SEQ ID NO: 683 - protein, 14 aa, Artificial
  FR2 sequence
WYRQAPGKQRDLVA

SEQ ID NO: 684 - protein, 14 aa, Artificial
  FR2 sequence
WVRQAPGKGLEWVS

SEQ ID NO: 685 - protein, 14 aa, Artificial
  FR2 sequence
WVRQAPGKGLEWVS

SEQ ID NO: 686 - protein, 14 aa, Artificial
  FR2 sequence
WVRQAPGKELEWIS

SEQ ID NO: 687 - protein, 14 aa, Artificial
  FR2 sequence
WVRQAPGKGLEWVS

SEQ ID NO: 688 - protein, 14 aa, Artificial
  FR2 sequence
WVRQAPGKGLEWVS

SEQ ID NO: 689 - protein, 14 aa, Artificial
  FR2 sequence
WVRQAPGKGLEWVS

SEQ ID NO: 690 - protein, 14 aa, Artificial
  FR2 sequence
WVRQAPGKGFEWVS

SEQ ID NO: 691 - protein, 14 aa, Artificial
  FR2 sequence
WVRQAPGKGLEWVS

SEQ ID NO: 692 - protein, 14 aa, Artificial
  FR2 sequence
WVRQAPGKGLEWVS

SEQ ID NO: 693 - protein, 14 aa, Artificial
  FR2 sequence
WVRQAPGKGLEWVS

SEQ ID NO: 694 - protein, 14 aa, Artificial
  FR2 sequence
WVRQAPGKGLEWVS

SEQ ID NO: 695 - protein, 14 aa, Artificial
  FR2 sequence
WVRQAPGKGLEWVS

SEQ ID NO: 696 - protein, 14 aa, Artificial
  FR2 sequence
WVRQAPGKGLEWVS

SEQ ID NO: 697 - protein, 14 aa, Artificial
  FR2 sequence
WVRQAPGKGLEWVS

SEQ ID NO: 698 - protein, 14 aa, Artificial
  FR2 sequence
WVRQAPGKGLEWVS

SEQ ID NO: 699 - protein, 14 aa, Artificial
  FR2 sequence
WVRQAPGKGLEWVS

SEQ ID NO: 700 - protein, 14 aa, Artificial
  FR2 sequence
WVRQAPGKGLEWVS

SEQ ID NO: 701 - protein, 14 aa, Artificial
  FR2 sequence
WVRQAPGKGLEWVS

SEQ ID NO: 702 - protein, 14 aa, Artificial
  FR2 sequence
WVRQAPGKGLEWVS

SEQ ID NO: 703 - protein, 14 aa, Artificial
  FR2 sequence
WVRQAPGKGLEWVS

SEQ ID NO: 704 - protein, 14 aa, Artificial
  FR2 sequence
WVRQAPGKGLEWVS

SEQ ID NO: 705 - protein, 14 aa, Artificial
  FR2 sequence
WVRQAPGKGLEWVS

SEQ ID NO: 706 - protein, 14 aa, Artificial
  FR2 sequence
WVRQAPGKGLEWVS

SEQ ID NO: 707 - protein, 14 aa, Artificial
  FR2 sequence
WVRQAPGKGLEWVS

SEQ ID NO: 708 - protein, 14 aa, Artificial
  FR2 sequence
WVRQAPGKGLEWVS

SEQ ID NO: 709 - protein, 14 aa, Artificial
  FR2 sequence
WVRQAPGKGLEWVS

SEQ ID NO: 710 - protein, 14 aa, Artificial
  FR2 sequence
WVRQAPGKGLEWVS

SEQ ID NO: 711 - protein, 14 aa, Artificial
  FR2 sequence
WVRQAPGKGLEWIS

SEQ ID NO: 712 - protein, 14 aa, Artificial
  FR2 sequence
WVRQAPGKGLEWIS

SEQ ID NO: 713 - protein, 14 aa, Artificial
  FR2 sequence
WVRQAPGKGLEWVS

SEQ ID NO: 714 - protein, 14 aa, Artificial
  FR2 sequence
WVRQAPGKGLEWIS

SEQ ID NO: 715 - protein, 14 aa, Artificial
  FR2 sequence
WVRQVPGKGLEWVS

SEQ ID NO: 716 - protein, 14 aa, Artificial
  FR2 sequence
WVRQAPGKGLEWVS

SEQ ID NO: 717 - protein, 14 aa, Artificial
  FR2 sequence
WVRQAPGKGLEWIS

SEQ ID NO: 718 - protein, 14 aa, Artificial
  FR2 sequence
WVRQAPGKGLEWVS

SEQ ID NO: 719 - protein, 14 aa, Artificial
  FR2 sequence
WVRQASGKGLEWVS

SEQ ID NO: 720 - protein, 14 aa, Artificial
  FR2 sequence
WVRQAPGKGLEWVS

SEQ ID NO: 721 - protein, 14 aa, Artificial
  FR2 sequence
WVRQAPGKGLEWVS

SEQ ID NO: 722 - protein, 14 aa, Artificial
  FR2 sequence
WVRQAPGKGLEWVS

SEQ ID NO: 723 - protein, 14 aa, Artificial
  FR2 sequence
WVRQAPGKGLEWVS

SEQ ID NO: 724 - protein, 14 aa, Artificial
  FR2 sequence
WVRQAPGKGLEWVS

SEQ ID NO: 725 - protein, 14 aa, Artificial
  FR2 sequence
WVRQAPGKGLEWVS

SEQ ID NO: 726 - protein, 14 aa, Artificial
  FR2 sequence
WVRQAPGKGLEWVS

SEQ ID NO: 727 - protein, 14 aa, Artificial
  FR2 sequence
WVRQAPGKGLEWVS

SEQ ID NO: 728 - protein, 14 aa, Artificial
  FR2 sequence
WVRQAPGKGLEWVS

SEQ ID NO: 729 - protein, 14 aa, Artificial
  FR2 sequence
WVRQAPGKGLEWVS

SEQ ID NO: 730 - protein, 14 aa, Artificial
  FR2 sequence
WVRQAPGKGLEWVS

SEQ ID NO: 731 - protein, 14 aa, Artificial
  FR2 sequence
WVRQASGKGLEWVS

SEQ ID NO: 732 - protein, 14 aa, Artificial
  FR2 sequence
WVRQAPGKGLEWVS

SEQ ID NO: 733 - protein, 14 aa, Artificial
  FR2 sequence
WVRQAPGKGLEWVS

SEQ ID NO: 734 - protein, 14 aa, Artificial
  FR2 sequence
WVRQAPGKGLEWVS

SEQ ID NO: 735 - protein, 14 aa, Artificial
  FR2 sequence
WVRQTPGKGLEWVS

SEQ ID NO: 736 - protein, 14 aa, Artificial
  FR2 sequence
WVRQVPGKGLEWVS

SEQ ID NO: 737 - protein, 14 aa, Artificial
  FR2 sequence
WYRQAPGKQRELVA

SEQ ID NO: 738 - protein, 14 aa, Artificial
  FR2 sequence
WFRQSPGKERDLVA

SEQ ID NO: 739 - protein, 14 aa, Artificial
  FR2 sequence
WYRQAPGKQRELVA

SEQ ID NO: 740 - protein, 14 aa, Artificial
  FR2 sequence
WFRQVPGKEREFVA

SEQ ID NO: 741 - protein, 14 aa, Artificial
  FR2 sequence
WFRQAPGKEREFVA

SEQ ID NO: 742 - protein, 14 aa, Artificial
  FR2 sequence
WFRQAPGKDREFVA

SEQ ID NO: 743 - protein, 14 aa, Artificial
  FR2 sequence
WFRQAPGKEREFVA

SEQ ID NO: 744 - protein, 14 aa, Artificial
  FR2 sequence
WFRQAPGKDREFVA

SEQ ID NO: 745 - protein, 14 aa, Artificial
  FR2 sequence
WFRQAPGKERAFVA

SEQ ID NO: 746 - protein, 14 aa, Artificial
  FR2 sequence
WFRQAPGKERAFVA

SEQ ID NO: 747 - protein, 14 aa, Artificial
  FR2 sequence
WFRQAPGKERAFVA

SEQ ID NO: 748 - protein, 14 aa, Artificial
  FR2 sequence
WFRQAPGKERAFVA

SEQ ID NO: 749 - protein, 14 aa, Artificial
  FR2 sequence
WFRQAPGKEREFVA

SEQ ID NO: 750 - protein, 14 aa, Artificial
  FR2 sequence
WFRQAPGKEREFVA

SEQ ID NO: 751 - protein, 14 aa, Artificial
  FR2 sequence
WFRQAPGKEREFVA

SEQ ID NO: 752 - protein, 14 aa, Artificial
  FR2 sequence
WYRQAPGQQREWVA

SEQ ID NO: 753 - protein, 14 aa, Artificial
  FR2 sequence
WFRQAPGKEREFVA

SEQ ID NO: 754 - protein, 14 aa, Artificial
  FR2 sequence
WFRQASGKEREGVS

SEQ ID NO: 755 - protein, 14 aa, Artificial
  FR2 sequence
WVRQAPGKGLEWVS

SEQ ID NO: 756 - protein, 14 aa, Artificial
  FR2 sequence
WFRQAPGKEREFVA

SEQ ID NO: 757 - protein, 14 aa, Artificial
  FR2 sequence
WYRQAPGKQRDWVA

SEQ ID NO: 758 - protein, 14 aa, Artificial
  FR2 sequence
WYRQAPGKQRDWVA

SEQ ID NO: 759 - protein, 14 aa, Artificial
  FR2 sequence
WYRQAPGKQRDWVA

SEQ ID NO: 760 - protein, 14 aa, Artificial
  FR2 sequence
WYRQAPGKQRDWVA

SEQ ID NO: 761 - protein, 14 aa, Artificial
  FR2 sequence
WYRQAQGKQRDWVA

SEQ ID NO: 762 - protein, 14 aa, Artificial
  FR2 sequence
WYRQAPGKPRDWVA

SEQ ID NO: 763 - protein, 14 aa, Artificial
  FR2 sequence
WYRQPPGNERDWVA

SEQ ID NO: 764 - protein, 14 aa, Artificial
  FR2 sequence
WYRQTPGKSRDWVA

SEQ ID NO: 765 - protein, 14 aa, Artificial
  FR2 sequence
WYRQTPGNQRDWLA

SEQ ID NO: 766 - protein, 14 aa, Artificial
  FR2 sequence
WYRQAPGKQRDWVA

SEQ ID NO: 767 - protein, 14 aa, Artificial
  FR2 sequence
WYRQTPGNQRDWLA

SEQ ID NO: 768 - protein, 14 aa, Artificial
  FR2 sequence
WYRQTPGNQRDWLA

SEQ ID NO: 769 - protein, 14 aa, Artificial
  FR2 sequence
WYRQAPGKTRDWVA

SEQ ID NO: 770 - protein, 14 aa, Artificial
  FR2 sequence
WYRQGPGKQRELVA

SEQ ID NO: 771 - protein, 14 aa, Artificial
  FR2 sequence
WYRQAPGQQREWVA

SEQ ID NO: 772 - protein, 14 aa, Artificial
  FR2 sequence
WYRQAPGQQREWVA

SEQ ID NO: 773 - protein, 14 aa, Artificial
  FR2 sequence
WYRQAPGKQRDWVA

SEQ ID NO: 774 - protein, 14 aa, Artificial
  FR2 sequence
WYRQAPGKQRDWVA

SEQ ID NO: 775 - protein, 14 aa, Artificial
  FR2 sequence
WYRQPPGKQRDWVG

SEQ ID NO: 776 - protein, 14 aa, Artificial
  FR2 sequence
WYRQAPGKQRDWVA

SEQ ID NO: 777 - protein, 14 aa, Artificial
  FR2 sequence
WYRQAPGKQRDWVA

SEQ ID NO: 778 - protein, 14 aa, Artificial
  FR2 sequence
WYRQAPGKQRDWVA

SEQ ID NO: 779 - protein, 14 aa, Artificial
  FR2 sequence
WYRQAPGKQRDWVA

SEQ ID NO: 780 - protein, 14 aa, Artificial
  FR2 sequence
WYRQAPGRQRDWVA

SEQ ID NO: 781 - protein, 14 aa, Artificial
  FR2 sequence
WYRQAPGRQRDWVA

SEQ ID NO: 782 - protein, 14 aa, Artificial
  FR2 sequence
WYRQAPGKQRDWGA

SEQ ID NO: 783 - protein, 14 aa, Artificial
  FR2 sequence
WYRQAPGKQRDWVA

SEQ ID NO: 784 - protein, 14 aa, Artificial
  FR2 sequence
WYRQAPGKQRDWVA

SEQ ID NO: 785 - protein, 14 aa, Artificial
  FR2 sequence
WYRQAPGKQRDWVA

SEQ ID NO: 786 - protein, 14 aa, Artificial
  FR2 sequence
WYRQAPGRQRDWVA

SEQ ID NO: 787 - protein, 14 aa, Artificial
  FR2 sequence
WYRQAPGRQRDWVA

SEQ ID NO: 788 - protein, 14 aa, Artificial
  FR2 sequence
WYRQAPGRQRDWVA

SEQ ID NO: 789 - protein, 14 aa, Artificial
  FR2 sequence
WFRQAPGKERECVA

SEQ ID NO: 790 - protein, 14 aa, Artificial
  FR2 sequence
WFRQAPGKERECVA

SEQ ID NO: 791 - protein, 14 aa, Artificial
  FR2 sequence
WYRQAPGKQREFVA

SEQ ID NO: 792 - protein, 14 aa, Artificial
  FR2 sequence
WYRQAPGRQRDWVA

SEQ ID NO: 793 - protein, 14 aa, Artificial
  FR2 sequence
WFRQAPGKEREEVS

SEQ ID NO: 794 - protein, 14 aa, Artificial
  FR2 sequence
WYRQAPEKQRELVA

SEQ ID NO: 795 - protein, 14 aa, Artificial
  FR2 sequence
WYRQTPGKQREFVA

SEQ ID NO: 796 - protein, 14 aa, Artificial
  FR2 sequence
WYRQTPGKQREFVA

SEQ ID NO: 797 - protein, 14 aa, Artificial
  FR2 sequence
WYRQTPGKQREFVA

SEQ ID NO: 798 - protein, 14 aa, Artificial
  FR2 sequence
WYRQTPGKQREFVA

SEQ ID NO: 799 - protein, 14 aa, Artificial
  FR2 sequence
WYRQTPGNQREFVA

SEQ ID NO: 800 - protein, 14 aa, Artificial
  FR2 sequence
WYRQPPGNQREWVA

SEQ ID NO: 801 - protein, 14 aa, Artificial
  FR2 sequence
WYRQAPGEQREWVA

SEQ ID NO: 802 - protein, 14 aa, Artificial
  FR2 sequence
WYRQAPGKQRDWVA

SEQ ID NO: 803 - protein, 14 aa, Artificial
  FR2 sequence
WYRQAPGKQRDWVA

SEQ ID NO: 804 - protein, 14 aa, Artificial
  FR2 sequence
WYRQAPGKQRDWVA

SEQ ID NO: 805 - protein, 14 aa, Artificial
  FR2 sequence
WYRQAPGNQRDWVA

SEQ ID NO: 806 - protein, 14 aa, Artificial
  FR2 sequence
WYRQAPGKQRDWVA

SEQ ID NO: 807 - protein, 14 aa, Artificial
  FR2 sequence
WYRQAPGKQRDWVA

SEQ ID NO: 808 - protein, 14 aa, Artificial
  FR2 sequence
WVRQAPGKGLEWVS

SEQ ID NO: 809 - protein, 14 aa, Artificial
  FR2 sequence
WYRQAPGKQRDLVA

SEQ ID NO: 810 - protein, 14 aa, Artificial
  FR2 sequence
WYRQAPGKQRDLVA

SEQ ID NO: 811 - protein, 14 aa, Artificial
  FR2 sequence
WYRQAPGKQRELVA

SEQ ID NO: 812 - protein, 14 aa, Artificial
  FR2 sequence
WYRQAPGKERELVA

SEQ ID NO: 813 - protein, 14 aa, Artificial
  FR2 sequence
WYRQFPGKERELVA

SEQ ID NO: 814 - protein, 14 aa, Artificial
  FR2 sequence
WYRQAPGNERILVA

SEQ ID NO: 815 - protein, 14 aa, Artificial
  FR2 sequence
WYRQAPGKQRELVT

SEQ ID NO: 816 - protein, 14 aa, Artificial
  FR2 sequence
WFRQAPGDGREFVA

SEQ ID NO: 817 - protein, 14 aa, Artificial
  FR2 sequence
WVRQATGKGLEWVS

SEQ ID NO: 818 - protein, 14 aa, Artificial
  FR2 sequence
WVRQAPGKGLEWVS

SEQ ID NO: 819 - protein, 14 aa, Artificial
  FR2 sequence
WYRQSPGKQRELVA

SEQ ID NO: 820 - protein, 14 aa, Artificial
  FR2 sequence
WYRQAPGKQRELVA

SEQ ID NO: 821 - protein, 14 aa, Artificial
  FR2 sequence
WYRQAPGKQRELVA

SEQ ID NO: 822 - protein, 14 aa, Artificial
  FR2 sequence
WVRQAPGKGLEWVS

SEQ ID NO: 823 - protein, 14 aa, Artificial
  FR2 sequence
WVRQAPGKGLEWVS

SEQ ID NO: 824 - protein, 14 aa, Artificial
  FR2 sequence
WFRQAPGKEREGVS

SEQ ID NO: 825 - protein, 14 aa, Artificial
  FR2 sequence
WVRQAPGKGLEWVS

SEQ ID NO: 826 - protein, 14 aa, Artificial
  FR2 sequence
WYRQPPGNQREWVA

SEQ ID NO: 827 - protein, 14 aa, Artificial
  FR2 sequence
WYRQPPGNQREWVA

SEQ ID NO: 828 - protein, 14 aa, Artificial
  FR2 sequence
WYRQPPGNQREWVA

SEQ ID NO: 829 - protein, 14 aa, Artificial
  FR2 sequence
WYRQPPGNQREWVA

SEQ ID NO: 830 - protein, 14 aa, Artificial
  FR2 sequence
WFRQAPGKEREFVA

SEQ ID NO: 831 - protein, 14 aa, Artificial
  FR2 sequence
WVRQAPGKGPEWVS

SEQ ID NO: 832 - protein, 14 aa, Artificial
  FR2 sequence
WFRQAPGKEREFVA

SEQ ID NO: 833 - protein, 14 aa, Artificial
  FR2 sequence
WFRQAPGTEREFIA

SEQ ID NO: 834 - protein, 14 aa, Artificial
  FR2 sequence
WFRQAPGTEREFIA

SEQ ID NO: 835 - protein, 14 aa, Artificial
  FR2 sequence
WFRQAPGKEREFVG

SEQ ID NO: 836 - protein, 14 aa, Artificial
  FR2 sequence
WFRQAPGKERAFVA

SEQ ID NO: 837 - protein, 14 aa, Artificial
  FR2 sequence
WFRQAPGKEREFVA

SEQ ID NO: 838 - protein, 14 aa, Artificial
  FR2 sequence
WFRQAPGKEREFVA

SEQ ID NO: 839 - protein, 14 aa, Artificial
  FR2 sequence
WFRQAPGKEREFVA

SEQ ID NO: 840 - protein, 14 aa, Artificial
  FR2 sequence
WFRQAPGKEREFVA

SEQ ID NO: 841 - protein, 14 aa, Artificial
  FR2 sequence
WYRQAPGKQRELAA

SEQ ID NO: 842 - protein, 14 aa, Artificial
  FR2 sequence
WFRQAPGKEREFVA

SEQ ID NO: 843 - protein, 14 aa, Artificial
  FR2 sequence
WFRQAPGKERDFVA

SEQ ID NO: 844 - protein, 14 aa, Artificial
  FR2 sequence
WFRQTPGKEREFVA

SEQ ID NO: 845 - protein, 14 aa, Artificial
  FR2 sequence
WYRQRPGKPREWVG

SEQ ID NO: 846 - protein, 14 aa, Artificial
  FR2 sequence
WFRQAPGKEREFVA

SEQ ID NO: 847 - protein, 14 aa, Artificial
  FR2 sequence
WFRQAPGKERELIA

SEQ ID NO: 848 - protein, 14 aa, Artificial
  FR2 sequence
WFRQAPGKEREFVA

SEQ ID NO: 849 - protein, 14 aa, Artificial
  FR2 sequence
WFRQAPGKERDFVA

SEQ ID NO: 850 - protein, 14 aa, Artificial
  FR2 sequence
WFRQAPGKEREFVT

SEQ ID NO: 851 - protein, 14 aa, Artificial
  FR2 sequence
WYRQAPGKQREFVA

SEQ ID NO: 852 - protein, 14 aa, Artificial
  FR2 sequence
WYRQAPGKQRERVA

SEQ ID NO: 853 - protein, 14 aa, Artificial
  FR2 sequence
WFRRAPGKEREFVA

SEQ ID NO: 854 - protein, 14 aa, Artificial
  FR2 sequence
WFRQAPEKEREFVA

SEQ ID NO: 855 - protein, 14 aa, Artificial
  FR2 sequence
WFRQAPGKEREFVA

SEQ ID NO: 856 - protein, 14 aa, Artificial
  FR2 sequence
WFRQAPGKEREFVA

SEQ ID NO: 857 - protein, 14 aa, Artificial
  FR2 sequence
WFRQAPGKEREFVA

SEQ ID NO: 858 - protein, 14 aa, Artificial
  FR2 sequence
WFRQAPGKEREFVA

SEQ ID NO: 859 - protein, 14 aa, Artificial
  FR2 sequence
WFRQAPGNERELVS

SEQ ID NO: 860 - protein, 14 aa, Artificial
  FR2 sequence
WFRQAPGKEREFVA

SEQ ID NO: 861 - protein, 14 aa, Artificial
  FR2 sequence
WFRQAPGKDREFVS

SEQ ID NO: 862 - protein, 14 aa, Artificial
  FR2 sequence
WFRQAPGKEREFVA

SEQ ID NO: 863 - protein, 14 aa, Artificial
  FR2 sequence
WFRQAPGKERDFVA

SEQ ID NO: 864 - protein, 14 aa, Artificial
  FR2 sequence
WFRQAPGKEREFVA

SEQ ID NO: 865 - protein, 14 aa, Artificial
  FR2 sequence
WFRQAPGKEREFVA

SEQ ID NO: 866 - protein, 14 aa, Artificial
  FR2 sequence
WFRQAPGKEREFVA

SEQ ID NO: 867 - protein, 14 aa, Artificial
  FR2 sequence
WFRQAPGKEREFVA

SEQ ID NO: 868 - protein, 14 aa, Artificial
  FR2 sequence
WFRQAPGKEREFVA

SEQ ID NO: 869 - protein, 14 aa, Artificial
  FR2 sequence
WFRQAPGTEREFVA

SEQ ID NO: 870 - protein, 14 aa, Artificial
  FR2 sequence
WFRQAPGKEREFVA

SEQ ID NO: 871 - protein, 14 aa, Artificial
  FR2 sequence
WVRQAPGKGLEWVS

SEQ ID NO: 872 - protein, 14 aa, Artificial
  FR2 sequence
WFRQSPGEEREFLA

SEQ ID NO: 873 - protein, 14 aa, Artificial
  FR2 sequence
WFRQAPGKEREFVA

SEQ ID NO: 874 - protein, 14 aa, Artificial
  FR2 sequence
WFRQAPGKAREFVA

SEQ ID NO: 875 - protein, 14 aa, Artificial
  FR2 sequence
WFRQTPGKEREFVA

SEQ ID NO: 876 - protein, 14 aa, Artificial
  FR2 sequence
WFRQAPGKEREFVS

SEQ ID NO: 877 - protein, 14 aa, Artificial
  FR2 sequence
WFRQAPGKEREFVA

SEQ ID NO: 878 - protein, 14 aa, Artificial
  FR2 sequence
WFRQAPGKEREFVT

SEQ ID NO: 879 - protein, 14 aa, Artificial
  FR2 sequence
WFRQAPGKGRESVA

SEQ ID NO: 880 - protein, 14 aa, Artificial
  FR2 sequence
WFRQAPGKERESVA

SEQ ID NO: 881 - protein, 14 aa, Artificial
  FR2 sequence
WFRQAPGKEREFVA

SEQ ID NO: 882 - protein, 14 aa, Artificial
  FR2 sequence
WFRQAPGKERESVA

SEQ ID NO: 883 - protein, 14 aa, Artificial
  FR2 sequence
WFRQAPGNEREFVA

SEQ ID NO: 884 - protein, 14 aa, Artificial
  FR2 sequence
WYRPAPGKQRELVA

SEQ ID NO: 885 - protein, 14 aa, Artificial
  FR2 sequence
WFRQAPGKEREFVV

SEQ ID NO: 886 - protein, 14 aa, Artificial
  FR2 sequence
WYRQAPGKQRELVA

SEQ ID NO: 887 - protein, 14 aa, Artificial
  FR2 sequence
WFRQAPGKEREFVA

SEQ ID NO: 888 - protein, 14 aa, Artificial
  FR2 sequence
WFRQAPGKEREFVA

SEQ ID NO: 889 - protein, 14 aa, Artificial
  FR2 sequence
WYRLAPGNQRELVA

SEQ ID NO: 890 - protein, 14 aa, Artificial
  FR2 sequence
WYRQAPGNQREFVA

SEQ ID NO: 891 - protein, 14 aa, Artificial
  FR2 sequence
WYRQAPGKQREFVA

SEQ ID NO: 892 - protein, 14 aa, Artificial
  FR2 sequence
WYRQAPGEQRELVA

SEQ ID NO: 893 - protein, 14 aa, Artificial
  FR2 sequence
WYRQGPGKEREFVA

SEQ ID NO: 894 - protein, 14 aa, Artificial
  FR2 sequence
WFRQAPGKEREFVA

SEQ ID NO: 895 - protein, 14 aa, Artificial
  FR2 sequence
WFRQAPGEEREFVT

SEQ ID NO: 896 - protein, 14 aa, Artificial
  FR2 sequence
WFRQAPGKEREFRE

SEQ ID NO: 897 - protein, 14 aa, Artificial
  FR2 sequence
WFRQAPGTERELVA

SEQ ID NO: 898 - protein, 14 aa, Artificial
  FR2 sequence
WYRQAPGNQRELVA

SEQ ID NO: 899 - protein, 14 aa, Artificial
  FR2 sequence
WFRQAPGKEREFVS

SEQ ID NO: 900 - protein, 14 aa, Artificial
  FR2 sequence
WVRQAPGKAREFVA

SEQ ID NO: 901 - protein, 14 aa, Artificial
  FR2 sequence
WVRQAPGKAREFVA

SEQ ID NO: 902 - protein, 14 aa, Artificial
  FR2 sequence
WFRQALGQGREFVA

SEQ ID NO: 903 - protein, 14 aa, Artificial
  FR2 sequence
WFRQAPGKERESVA

SEQ ID NO: 904 - protein, 14 aa, Artificial
  FR2 sequence
WFRQAPGKEREFVA

SEQ ID NO: 905 - protein, 14 aa, Artificial
  FR2 sequence
WFRQAPGKEREFVA

SEQ ID NO: 906 - protein, 14 aa, Artificial
  FR2 sequence
WYRQGPGQQLELVA

SEQ ID NO: 907 - protein, 14 aa, Artificial
  FR2 sequence
WFRQAPGKEREFVA

SEQ ID NO: 908 - protein, 14 aa, Artificial
  FR2 sequence
WFRQAPGKEREFVG

SEQ ID NO: 909 - protein, 14 aa, Artificial
  FR2 sequence
WYRQAPGKQREFVA

SEQ ID NO: 910 - protein, 14 aa, Artificial
  FR2 sequence
WYRQAPGNQRDLVA

SEQ ID NO: 911 - protein, 14 aa, Artificial
  FR2 sequence
WFRQAPGKEREFVS

SEQ ID NO: 912 - protein, 14 aa, Artificial
  FR2 sequence
WFRQAPGKEREFVA

SEQ ID NO: 913 - protein, 14 aa, Artificial
  FR2 sequence
WFRQAPEKEREAVS

SEQ ID NO: 914 - protein, 14 aa, Artificial
  FR2 sequence
WFRQAPGKGREFVA

SEQ ID NO: 915 - protein, 14 aa, Artificial
  FR2 sequence
WFRQAPGKEREFVA

SEQ ID NO: 916 - protein, 14 aa, Artificial
  FR2 sequence
WLRQAPGKEREFVA

SEQ ID NO: 917 - protein, 14 aa, Artificial
  FR2 sequence
WFRQAPGKVREFVA

SEQ ID NO: 918 - protein, 14 aa, Artificial
  FR2 sequence
WFRQAPGKVREFVA

SEQ ID NO: 919 - protein, 14 aa, Artificial
  FR2 sequence
WFRQGPGKRRELVA

SEQ ID NO: 920 - protein, 14 aa, Artificial
  FR2 sequence
WFRQSPGKERESVA

SEQ ID NO: 921 - protein, 14 aa, Artificial
  FR2 sequence
WFRQGPGKEREFAA

SEQ ID NO: 922 - protein, 14 aa, Artificial
  FR2 sequence
WFRQAPGKEREFIA

SEQ ID NO: 923 - protein, 14 aa, Artificial
  FR2 sequence
WFRQAPRKEREFVA

SEQ ID NO: 924 - protein, 14 aa, Artificial
  FR2 sequence
WFRQAPGSERDFVA

SEQ ID NO: 925 - protein, 14 aa, Artificial
  FR2 sequence
WSREAPGKRRELVA

SEQ ID NO: 926 - protein, 14 aa, Artificial
  FR2 sequence
WFRQAPGKEREFVA

SEQ ID NO: 927 - protein, 14 aa, Artificial
  FR2 sequence
WFRQAPGKEREFVA

SEQ ID NO: 928 - protein, 14 aa, Artificial
  FR2 sequence
WFRQAPGKEREFVA

SEQ ID NO: 929 - protein, 14 aa, Artificial
  FR2 sequence
WYRQAPGNQRELVA

SEQ ID NO: 930 - protein, 14 aa, Artificial
  FR2 sequence
WFRQAPGKEREFVA

SEQ ID NO: 931 - protein, 14 aa, Artificial
  FR2 sequence
WFRQAPGKAREFVA

SEQ ID NO: 932 - protein, 14 aa, Artificial
  FR2 sequence
WFRQAPGKERGFVA

SEQ ID NO: 933 - protein, 14 aa, Artificial
  FR2 sequence
WFRQAPGKEREVVA

SEQ ID NO: 934 - protein, 14 aa, Artificial
  FR2 sequence
WYRKAPGKQREVVA

SEQ ID NO: 935 - protein, 14 aa, Artificial
  FR2 sequence
WYRQAPGNQRELVA

SEQ ID NO: 936 - protein, 14 aa, Artificial
  FR2 sequence
WFRQAPGKEREFVS

SEQ ID NO: 937 - protein, 14 aa, Artificial
  FR2 sequence
WFRQAPGKEREFVA

SEQ ID NO: 938 - protein, 14 aa, Artificial
  FR2 sequence
WFRQSPGKEREFVG

SEQ ID NO: 939 - protein, 14 aa, Artificial
  FR2 sequence
WFRQAPGKAREFVA

SEQ ID NO: 940 - protein, 14 aa, Artificial
  FR2 sequence
WFRQAPGKEREFVA

SEQ ID NO: 941 - protein, 14 aa, Artificial
  FR2 sequence
WFRQAPGEEREFVA

SEQ ID NO: 942 - protein, 14 aa, Artificial
  FR2 sequence
WFRRAPGKEREHVA

SEQ ID NO: 943 - protein, 14 aa, Artificial
  FR2 sequence
WHRQVSGKERELVA

SEQ ID NO: 944 - protein, 14 aa, Artificial
  FR2 sequence
WHRQVPGKQRELVA

SEQ ID NO: 945 - protein, 14 aa, Artificial
  FR2 sequence
WHRQAPGKERELVS

SEQ ID NO: 946 - protein, 14 aa, Artificial
  FR2 sequence
WFRQAPGKEREGVS

SEQ ID NO: 947 - protein, 14 aa, Artificial
  FR2 sequence
WVRQAPGKGPERVS

SEQ ID NO: 948 - protein, 14 aa, Artificial
  FR2 sequence
WFRQGPGKEREFVA

SEQ ID NO: 949 - protein, 14 aa, Artificial
  FR2 sequence
WFRQAPGKAREGVS

SEQ ID NO: 950 - protein, 14 aa, Artificial
  FR2 sequence
WYRQAPGNERELVA

SEQ ID NO: 951 - protein, 17 aa, Artificial
  CDR2 sequence
SINWSGTHTDYADSVKG

SEQ ID NO: 952 - protein, 17 aa, Artificial
  CDR2 sequence
SINWSGTHTDYADSVKG

SEQ ID NO: 953 - protein, 17 aa, Artificial
  CDR2 sequence
SINWSGTHTDYTDPVKG

SEQ ID NO: 954 - protein, 17 aa, Artificial
  CDR2 sequence
SINWSGTHTDYADSVKG

SEQ ID NO: 955 - protein, 17 aa, Artificial
  CDR2 sequence
SINWSGTHTDYADSVKG

SEQ ID NO: 956 - protein, 17 aa, Artificial
  CDR2 sequence
SINWSGTHTDYADSVKG

SEQ ID NO: 957 - protein, 17 aa, Artificial
  CDR2 sequence
SINWSGTHTDYADSVKG

SEQ ID NO: 958 - protein, 16 aa, Artificial
  CDR2 sequence
SIDSSGGTNYADSVKG

SEQ ID NO: 959 - protein, 17 aa, Artificial
  CDR2 sequence
SINWSGTHTDYADSVKG

SEQ ID NO: 960 - protein, 17 aa, Artificial
  CDR2 sequence
SINWSGTHTDYADSVKG

SEQ ID NO: 961 - protein, 17 aa, Artificial
  CDR2 sequence
SINWSGTHTDYADSVKG

SEQ ID NO: 962 - protein, 17 aa, Artificial
  CDR2 sequence
SINWSGTHTDYADSVKG

SEQ ID NO: 963 - protein, 17 aa, Artificial
  CDR2 sequence
SINWSGTHTDYADSVKG

SEQ ID NO: 964 - protein, 17 aa, Artificial
  CDR2 sequence
SINWSGTHTDYADSVKG

SEQ ID NO: 965 - protein, 17 aa, Artificial
  CDR2 sequence
SINWSGTHTDYADSVKG

SEQ ID NO: 966 - protein, 17 aa, Artificial
  CDR2 sequence
SINWSGTHTDYADSVKG

SEQ ID NO: 967 - protein, 17 aa, Artificial
  CDR2 sequence
SINWSGTHTDYADSVKG

SEQ ID NO: 968 - protein, 17 aa, Artificial
  CDR2 sequence
SINWSGTHTDYADSVRG

SEQ ID NO: 969 - protein, 17 aa, Artificial
  CDR2 sequence
SINWSGTHTDYTDSVKG

SEQ ID NO: 970 - protein, 17 aa, Artificial
  CDR2 sequence
SINWNVTHTDYAYSVKG

SEQ ID NO: 971 - protein, 17 aa, Artificial
  CDR2 sequence
SINWSGTHTDCADSVKG

SEQ ID NO: 972 - protein, 17 aa, Artificial
  CDR2 sequence
SINWSGTHTDYADSVKG

SEQ ID NO: 973 - protein, 17 aa, Artificial
  CDR2 sequence
SINWSGTHTDYADSVKG

SEQ ID NO: 974 - protein, 17 aa, Artificial
  CDR2 sequence
SINWSGTHTDYADSVKG

SEQ ID NO: 975 - protein, 17 aa, Artificial
  CDR2 sequence
SINWSGTHTDYADSVKG

SEQ ID NO: 976 - protein, 17 aa, Artificial
  CDR2 sequence
SINWSGTHTDYADSVKG

SEQ ID NO: 977 - protein, 17 aa, Artificial
  CDR2 sequence
SINWSGTHTDYADSVKG

SEQ ID NO: 978 - protein, 17 aa, Artificial
  CDR2 sequence
SINWNGTHTDYAYSVKG

SEQ ID NO: 979 - protein, 17 aa, Artificial
  CDR2 sequence
SINWSGTHTDYADSVKG

SEQ ID NO: 980 - protein, 17 aa, Artificial
  CDR2 sequence
SINWSGTHTDYADSVKG

SEQ ID NO: 981 - protein, 17 aa, Artificial
  CDR2 sequence
SINWSGTHTDYADSVKG

SEQ ID NO: 982 - protein, 17 aa, Artificial
  CDR2 sequence
AINWSGSHRNYADSVKG

SEQ ID NO: 983 - protein, 17 aa, Artificial
  CDR2 sequence
AINWSGTHRNYADSVKG

SEQ ID NO: 984 - protein, 17 aa, Artificial
  CDR2 sequence
AINWSGSHRNYADSVKG

SEQ ID NO: 985 - protein, 17 aa, Artificial
  CDR2 sequence
SINWSGSHRNYADSVKG

SEQ ID NO: 986 - protein, 17 aa, Artificial
  CDR2 sequence
SINWSGTHKDYADSVKG

SEQ ID NO: 987 - protein, 17 aa, Artificial
  CDR2 sequence
SINWSGTHTDYADSVKG

SEQ ID NO: 988 - protein, 17 aa, Artificial
  CDR2 sequence
SINWSGTHTDYTDSVKG

SEQ ID NO: 989 - protein, 17 aa, Artificial
  CDR2 sequence
SINWSGTHTDYADSVKG

SEQ ID NO: 990 - protein, 17 aa, Artificial
  CDR2 sequence
SINWSGTHTDYADSVKG

SEQ ID NO: 991 - protein, 17 aa, Artificial
  CDR2 sequence
SINWSGTHTDYTDSVKG

SEQ ID NO: 992 - protein, 17 aa, Artificial
  CDR2 sequence
SINWSGTHTDYADSVKG

SEQ ID NO: 993 - protein, 17 aa, Artificial
  CDR2 sequence
SINWSGTHTDYADSVKG

SEQ ID NO: 994 - protein, 17 aa, Artificial
  CDR2 sequence
SINWSGTHTDYTDSVKG

SEQ ID NO: 995 - protein, 17 aa, Artificial
  CDR2 sequence
SINWSGTHTGYTDSVKG

SEQ ID NO: 996 - protein, 17 aa, Artificial
  CDR2 sequence
SINWSGTHTDYTDSVKG

SEQ ID NO: 997 - protein, 17 aa, Artificial
  CDR2 sequence
SINWSGTHTDYTGSVKG

SEQ ID NO: 998 - protein, 17 aa, Artificial
  CDR2 sequence
SINWSGTHTDYTDSVKG

SEQ ID NO: 999 - protein, 17 aa, Artificial
  CDR2 sequence
SINWSGTHTDYTDSVKG

SEQ ID NO: 1000 - protein, 17 aa, Artificial
  CDR2 sequence
SINWSGTHTGYTDSVKG

SEQ ID NO: 1001 - protein, 17 aa, Artificial
  CDR2 sequence
SINWSGTHTDYTDSVKG

SEQ ID NO: 1002 - protein, 17 aa, Artificial
  CDR2 sequence
SINWSGTHTDYTDSVKG

SEQ ID NO: 1003 - protein, 17 aa, Artificial
  CDR2 sequence
SINWSGTHTDYTDSVKG

SEQ ID NO: 1004 - protein, 17 aa, Artificial
  CDR2 sequence
SINWSGTHTDYTDSVKG

SEQ ID NO: 1005 - protein, 17 aa, Artificial
  CDR2 sequence
SINWSGTHTDCTDSVKG

SEQ ID NO: 1006 - protein, 17 aa, Artificial
  CDR2 sequence
SINWSGTHTDYADSVKG

SEQ ID NO: 1007 - protein, 17 aa, Artificial
  CDR2 sequence
SINWSGTHTDYTGSVKG

SEQ ID NO: 1008 - protein, 17 aa, Artificial
  CDR2 sequence
SINWSGTHTDYTDSVKG

SEQ ID NO: 1009 - protein, 17 aa, Artificial
  CDR2 sequence
SINWSGTHTDYTDSVKG

SEQ ID NO: 1010 - protein, 17 aa, Artificial
  CDR2 sequence
SINWSGTHTDYTDSVKG

SEQ ID NO: 1011 - protein, 17 aa, Artificial
  CDR2 sequence
SINWSGTHTDYADSVKG

SEQ ID NO: 1012 - protein, 16 aa, Artificial
  CDR2 sequence
LISSIGDTYYADSVKG

SEQ ID NO: 1013 - protein, 17 aa, Artificial
  CDR2 sequence
GIMWDGRSLFYADSVKG

SEQ ID NO: 1014 - protein, 16 aa, Artificial
  CDR2 sequence
LISRVGVTSSADSVKG

SEQ ID NO: 1015 - protein, 16 aa, Artificial
  CDR2 sequence
TINWSGVTAYADSVKG

SEQ ID NO: 1016 - protein, 16 aa, Artificial
  CDR2 sequence
TINWSGVTAYADSIKG

SEQ ID NO: 1017 - protein, 16 aa, Artificial
  CDR2 sequence
TINWSGVTAYADSIKG

SEQ ID NO: 1018 - protein, 16 aa, Artificial
  CDR2 sequence
TINWSGATAYADSIKG

SEQ ID NO: 1019 - protein, 16 aa, Artificial
  CDR2 sequence
TINWSGVTAYADSIKG

SEQ ID NO: 1020 - protein, 16 aa, Artificial
  CDR2 sequence
TINWSGVTAYADSVKG

SEQ ID NO: 1021 - protein, 16 aa, Artificial
  CDR2 sequence
TINWSGVNAYADSVKG

SEQ ID NO: 1022 - protein, 16 aa, Artificial
  CDR2 sequence
TINWSGVNAYADSVKG

SEQ ID NO: 1023 - protein, 16 aa, Artificial
  CDR2 sequence
TINWSGVTAYADSVKG

SEQ ID NO: 1024 - protein, 16 aa, Artificial
  CDR2 sequence
TINWSGVTAYADSVKG

SEQ ID NO: 1025 - protein, 16 aa, Artificial
  CDR2 sequence
TINWSGVTAYADSVKG

SEQ ID NO: 1026 - protein, 16 aa, Artificial
  CDR2 sequence
TINWSGVTAYADSVKG

SEQ ID NO: 1027 - protein, 16 aa, Artificial
  CDR2 sequence
AISGAGDINYADSVKG

SEQ ID NO: 1028 - protein, 17 aa, Artificial
  CDR2 sequence
TISWNYGYTYYSDSVKG

SEQ ID NO: 1029 - protein, 17 aa, Artificial
  CDR2 sequence
CITSSDGSTYYADSVKG

SEQ ID NO: 1030 - protein, 17 aa, Artificial
  CDR2 sequence
AVDSGGGRTDYAHSVKG

SEQ ID NO: 1031 - protein, 17 aa, Artificial
  CDR2 sequence
TISRGGSATYYADSLKG

SEQ ID NO: 1032 - protein, 16 aa, Artificial
  CDR2 sequence
TISSHGLPVYADSVKG

SEQ ID NO: 1033 - protein, 16 aa, Artificial
  CDR2 sequence
TIGTSGPPRYADSVKG

SEQ ID NO: 1034 - protein, 16 aa, Artificial
  CDR2 sequence
TISSHGLPVYADSVKG

SEQ ID NO: 1035 - protein, 16 aa, Artificial
  CDR2 sequence
TISARGMPAYEDSVKG

SEQ ID NO: 1036 - protein, 16 aa, Artificial
  CDR2 sequence
TISSHGLPVYADSVKG

SEQ ID NO: 1037 - protein, 15 aa, Artificial
  CDR2 sequence
TIRNGAPVYADSVKG

SEQ ID NO: 1038 - protein, 15 aa, Artificial
  CDR2 sequence
TIRSGAPVYADSVKG

SEQ ID NO: 1039 - protein, 15 aa, Artificial
  CDR2 sequence
TIRSGTPVYADSVKG

SEQ ID NO: 1040 - protein, 16 aa, Artificial
  CDR2 sequence
TIGSSGTPAYADSVKG

SEQ ID NO: 1041 - protein, 16 aa, Artificial
  CDR2 sequence
TIGTGGTPAYADSFKG

SEQ ID NO: 1042 - protein, 16 aa, Artificial
  CDR2 sequence
TIGSSGTPAYADSVKG

SEQ ID NO: 1043 - protein, 16 aa, Artificial
  CDR2 sequence
TIGSSGTPAYADSVKG

SEQ ID NO: 1044 - protein, 16 aa, Artificial
  CDR2 sequence
TIGTHGTPLYADSVKG

SEQ ID NO: 1045 - protein, 16 aa, Artificial
  CDR2 sequence
TVNDGGTTSYADSVKG

SEQ ID NO: 1046 - protein, 16 aa, Artificial
  CDR2 sequence
AISGAGDINYADSVKG

SEQ ID NO: 1047 - protein, 16 aa, Artificial
  CDR2 sequence
AISGAGDINYADSVKG

SEQ ID NO: 1048 - protein, 16 aa, Artificial
  CDR2 sequence
TIAGDGSTVYADSMKG

SEQ ID NO: 1049 - protein, 16 aa, Artificial
  CDR2 sequence
TIAGDGSTVYADSMKG

SEQ ID NO: 1050 - protein, 16 aa, Artificial
  CDR2 sequence
TISSDGTANYADSVKG

SEQ ID NO: 1051 - protein, 16 aa, Artificial
  CDR2 sequence
TSDSGGTTLYADSVKG

SEQ ID NO: 1052 - protein, 16 aa, Artificial
  CDR2 sequence
TSGTGYGATYDDSVKG

SEQ ID NO: 1053 - protein, 16 aa, Artificial
  CDR2 sequence
TIAGDGSTVYADSMKG

SEQ ID NO: 1054 - protein, 16 aa, Artificial
  CDR2 sequence
TIGSDGTTIYADSVKG

SEQ ID NO: 1055 - protein, 17 aa, Artificial
  CDR2 sequence
TIYSPSGSAVYADSVKG

SEQ ID NO: 1056 - protein, 17 aa, Artificial
  CDR2 sequence
TIYSRSGGAVYADSVKG

SEQ ID NO: 1057 - protein, 16 aa, Artificial
  CDR2 sequence
TTYSRGGTTYNDSAKG

SEQ ID NO: 1058 - protein, 16 aa, Artificial
  CDR2 sequence
SIGTRGAPVYADSVNG

SEQ ID NO: 1059 - protein, 16 aa, Artificial
  CDR2 sequence
TSDSGGTTLYADSVKG

SEQ ID NO: 1060 - protein, 16 aa, Artificial
  CDR2 sequence
TSDSGGTTLYADSVKG

SEQ ID NO: 1061 - protein, 17 aa, Artificial
  CDR2 sequence
TIYSPSGSAVYADSVKG

SEQ ID NO: 1062 - protein, 17 aa, Artificial
  CDR2 sequence
TIYSPSGSAVYADSVKG

SEQ ID NO: 1063 - protein, 17 aa, Artificial
  CDR2 sequence
TIYSPSGSAVYADSVKG

SEQ ID NO: 1064 - protein, 17 aa, Artificial
  CDR2 sequence
SLYLNGDYPYYADSVKG

SEQ ID NO: 1065 - protein, 17 aa, Artificial
  CDR2 sequence
SMYLDGDYPYYADSVKG

SEQ ID NO: 1066 - protein, 16 aa, Artificial
  CDR2 sequence
SITKFGSTNYADSVKG

SEQ ID NO: 1067 - protein, 16 aa, Artificial
  CDR2 sequence
TSSNTGGTTYDDSVKG

SEQ ID NO: 1068 - protein, 17 aa, Artificial
  CDR2 sequence
CIASSDGSTYYAESVKG

SEQ ID NO: 1069 - protein, 16 aa, Artificial
  CDR2 sequence
SVSGGGNSDYASSVKG

SEQ ID NO: 1070 - protein, 16 aa, Artificial
  CDR2 sequence
SMRGSGSTNYADSARG

SEQ ID NO: 1071 - protein, 16 aa, Artificial
  CDR2 sequence
SMRGSGSTNYADSVRG

SEQ ID NO: 1072 - protein, 16 aa, Artificial
  CDR2 sequence
SMRGSGSTNYADSARG

SEQ ID NO: 1073 - protein, 16 aa, Artificial
  CDR2 sequence
SMRGSGSTNYADSVRG

SEQ ID NO: 1074 - protein, 16 aa, Artificial
  CDR2 sequence
TIHSSGSTIYADSVRG

SEQ ID NO: 1075 - protein, 16 aa, Artificial
  CDR2 sequence
TIGSNGFATYPDSVKG

SEQ ID NO: 1076 - protein, 16 aa, Artificial
  CDR2 sequence
TISRQGMSTYPDSVKG

SEQ ID NO: 1077 - protein, 16 aa, Artificial
  CDR2 sequence
TIGSDGLANYADSVKG

SEQ ID NO: 1078 - protein, 16 aa, Artificial
  CDR2 sequence
TIGSSGHPVYTDSVKG

SEQ ID NO: 1079 - protein, 16 aa, Artificial
  CDR2 sequence
TIGSGGTTNYADSVKG

SEQ ID NO: 1080 - protein, 16 aa, Artificial
  CDR2 sequence
TIGSAGLASYADSVRG

SEQ ID NO: 1081 - protein, 16 aa, Artificial
  CDR2 sequence
TISSAGGTAYADAVKG

SEQ ID NO: 1082 - protein, 16 aa, Artificial
  CDR2 sequence
TIAGDGSTVYADSMKG

SEQ ID NO: 1083 - protein, 16 aa, Artificial
  CDR2 sequence
GVGGDGVGSYADSVKG

SEQ ID NO: 1084 - protein, 16 aa, Artificial
  CDR2 sequence
SIDASGGTNYADSVKG

SEQ ID NO: 1085 - protein, 16 aa, Artificial
  CDR2 sequence
SIDSSGGTNYADSVKG

SEQ ID NO: 1086 - protein, 16 aa, Artificial
  CDR2 sequence
SINSDGSTGYTDSVKG

SEQ ID NO: 1087 - protein, 16 aa, Artificial
  CDR2 sequence
EISSADEPSFADAVKG

SEQ ID NO: 1088 - protein, 16 aa, Artificial
  CDR2 sequence
TILSEGDTNYVDPVKG

SEQ ID NO: 1089 - protein, 16 aa, Artificial
  CDR2 sequence
IISNGGTTSYRDSVKG

SEQ ID NO: 1090 - protein, 16 aa, Artificial
  CDR2 sequence
YITINGIANYVDSVKG

SEQ ID NO: 1091 - protein, 16 aa, Artificial
  CDR2 sequence
HIFRSGITSYASSVKG

SEQ ID NO: 1092 - protein, 17 aa, Artificial
  CDR2 sequence
GISWNGGSTNYADSVKG

SEQ ID NO: 1093 - protein, 17 aa, Artificial
  CDR2 sequence
AIKPDGSITYYADSVKG

SEQ ID NO: 1094 - protein, 16 aa, Artificial
  CDR2 sequence
AVDNDDNTEYSDSVAG

SEQ ID NO: 1095 - protein, 16 aa, Artificial
  CDR2 sequence
AIDDGGNTEYSDFVNG

SEQ ID NO: 1096 - protein, 16 aa, Artificial
  CDR2 sequence
TIAHDGSTNYANSVKG

SEQ ID NO: 1097 - protein, 18 aa, Artificial
  CDR2 sequence
AISSGGGSITTYADSVKG

SEQ ID NO: 1098 - protein, 18 aa, Artificial
  CDR2 sequence
AISSGGGSITTYADSVKG

SEQ ID NO: 1099 - protein, 17 aa, Artificial
  CDR2 sequence
CISSSDGSTYYADSVKG

SEQ ID NO: 1100 - protein, 17 aa, Artificial
  CDR2 sequence
SINWSGTHTDYAEDMKG

SEQ ID NO: 1101 - protein, 16 aa, Artificial
  CDR2 sequence
TIGSNGFATYPDSVKG

SEQ ID NO: 1102 - protein, 16 aa, Artificial
  CDR2 sequence
TIGSNGFATYPDSVKG

SEQ ID NO: 1103 - protein, 16 aa, Artificial
  CDR2 sequence
TIGSNGFATYPDSVKG

SEQ ID NO: 1104 - protein, 16 aa, Artificial
  CDR2 sequence
TIGSNGFATYPDSVKG

SEQ ID NO: 1105 - protein, 17 aa, Artificial
  CDR2 sequence
AIGSGDIITYYADSVKG

SEQ ID NO: 1106 - protein, 17 aa, Artificial
  CDR2 sequence
AINSGGGSTYYADSVKG

SEQ ID NO: 1107 - protein, 17 aa, Artificial
  CDR2 sequence
AISRSPGVTYYADSVKG

SEQ ID NO: 1108 - protein, 17 aa, Artificial
  CDR2 sequence
GIRWSDGSTYYADSVKG

SEQ ID NO: 1109 - protein, 17 aa, Artificial
  CDR2 sequence
GIRWSDGSTYYADSVKG

SEQ ID NO: 1110 - protein, 17 aa, Artificial
  CDR2 sequence
GIRWSDGSTYYADSVKG

SEQ ID NO: 1111 - protein, 17 aa, Artificial
  CDR2 sequence
AIRWSGGNTYYADSVKG

SEQ ID NO: 1112 - protein, 18 aa, Artificial
  CDR2 sequence
AINWRSGGSTYYADSVKG

SEQ ID NO: 1113 - protein, 17 aa, Artificial
  CDR2 sequence
AVRWSDDYTYYADSVKG

SEQ ID NO: 1114 - protein, 17 aa, Artificial
  CDR2 sequence
GINKSGGITHSADSVKG

SEQ ID NO: 1115 - protein, 17 aa, Artificial
  CDR2 sequence
NIKWSGDRIVYADSVKG

SEQ ID NO: 1116 - protein, 16 aa, Artificial
  CDR2 sequence
VIISSGTTTYADSVKG

SEQ ID NO: 1117 - protein, 17 aa, Artificial
  CDR2 sequence
AITDNGGSTYYADSVKG

SEQ ID NO: 1118 - protein, 16 aa, Artificial
  CDR2 sequence
AITSSGSTNYADSVKG

SEQ ID NO: 1119 - protein, 16 aa, Artificial
  CDR2 sequence
AITSSGSTNYADSVKG

SEQ ID NO: 1120 - protein, 16 aa, Artificial
  CDR2 sequence
TINSGGDTNYAGSVKG

SEQ ID NO: 1121 - protein, 17 aa, Artificial
  CDR2 sequence
AISSSGISTIYGDSVKG

SEQ ID NO: 1122 - protein, 17 aa, Artificial
  CDR2 sequence
HITWNGGSTYYADSVKG

SEQ ID NO: 1123 - protein, 18 aa, Artificial
  CDR2 sequence
AISGWSGGTTNYADSVKG

SEQ ID NO: 1124 - protein, 17 aa, Artificial
  CDR2 sequence
AISWNGVTIYYADSVKG

SEQ ID NO: 1125 - protein, 15 aa, Artificial
  CDR2 sequence
VISGVGTSYADSVKG

SEQ ID NO: 1126 - protein, 16 aa, Artificial
  CDR2 sequence
SISSGSAINYADSVKG

SEQ ID NO: 1127 - protein, 16 aa, Artificial
  CDR2 sequence
TLTSAGNTNYADSVKG

SEQ ID NO: 1128 - protein, 17 aa, Artificial
  CDR2 sequence
GIAWNGASIGSADSVRG

SEQ ID NO: 1129 - protein, 17 aa, Artificial
  CDR2 sequence
GITMSGFNTRYADSVKG

SEQ ID NO: 1130 - protein, 17 aa, Artificial
  CDR2 sequence
GISWSGGHTFYADSVKG

SEQ ID NO: 1131 - protein, 17 aa, Artificial
  CDR2 sequence
TIDWSGDTAFYADSVKG

SEQ ID NO: 1132 - protein, 17 aa, Artificial
  CDR2 sequence
AVSWDGRNTYYADSVKG

SEQ ID NO: 1133 - protein, 16 aa, Artificial
  CDR2 sequence
RVSWIRTTYYSDSVKG

SEQ ID NO: 1134 - protein, 17 aa, Artificial
  CDR2 sequence
AIGWSGASTYYIDSVEG

SEQ ID NO: 1135 - protein, 17 aa, Artificial
  CDR2 sequence
AIRWSGGTTFYGDSVKG

SEQ ID NO: 1136 - protein, 17 aa, Artificial
  CDR2 sequence
AITWNGTRTYYRDSVKG

SEQ ID NO: 1137 - protein, 17 aa, Artificial
  CDR2 sequence
AIRWSGGSAFYADSVKG

SEQ ID NO: 1138 - protein, 16 aa, Artificial
  CDR2 sequence
AITSSGSTNYADSVKG

SEQ ID NO: 1139 - protein, 16 aa, Artificial
  CDR2 sequence
AIRSSGGLFYALSVSG

SEQ ID NO: 1140 - protein, 16 aa, Artificial
  CDR2 sequence
AIRSGGTTLYEDSVKG

SEQ ID NO: 1141 - protein, 16 aa, Artificial
  CDR2 sequence
VIRSGGTTLYADSVKG

SEQ ID NO: 1142 - protein, 16 aa, Artificial
  CDR2 sequence
AIRSGGTTLYEDSVKG

SEQ ID NO: 1143 - protein, 16 aa, Artificial
  CDR2 sequence
AIRSGATTLYEDSVKG

SEQ ID NO: 1144 - protein, 16 aa, Artificial
  CDR2 sequence
VIRSGGTTLYEDSVKG

SEQ ID NO: 1145 - protein, 16 aa, Artificial
  CDR2 sequence
VTRSGGTTFYADSAKG

SEQ ID NO: 1146 - protein, 17 aa, Artificial
  CDR2 sequence
AINSGGGSTSYADSVKG

SEQ ID NO: 1147 - protein, 17 aa, Artificial
  CDR2 sequence
LITRNGETKKTADSVKG

SEQ ID NO: 1148 - protein, 17 aa, Artificial
  CDR2 sequence
AIRWSGGITYYADSVKG

SEQ ID NO: 1149 - protein, 17 aa, Artificial
  CDR2 sequence
AISRSGTGTYYAGSMKG

SEQ ID NO: 1150 - protein, 17 aa, Artificial
  CDR2 sequence
RVWWNGGSAYYADSVKG

SEQ ID NO: 1151 - protein, 17 aa, Artificial
  CDR2 sequence
AISPIGSSKYYADSVKG

SEQ ID NO: 1152 - protein, 17 aa, Artificial
  CDR2 sequence
AISTSGGGTDSADSVKG

SEQ ID NO: 1153 - protein, 17 aa, Artificial
  CDR2 sequence
AITWSGDSTNFADSVKG

SEQ ID NO: 1154 - protein, 16 aa, Artificial
  CDR2 sequence
TIFVGGTTYYSDSVKG

SEQ ID NO: 1155 - protein, 16 aa, Artificial
  CDR2 sequence
TIFVGGTTYYSDSVKG

SEQ ID NO: 1156 - protein, 17 aa, Artificial
  CDR2 sequence
AKTWSGASTYYADSVRG

SEQ ID NO: 1157 - protein, 16 aa, Artificial
  CDR2 sequence
TIFVGGTTYYSDSVKG

SEQ ID NO: 1158 - protein, 17 aa, Artificial
  CDR2 sequence
AITWNGASTSYADSVKG

SEQ ID NO: 1159 - protein, 16 aa, Artificial
  CDR2 sequence
RITSTGSTNYADSVKG

SEQ ID NO: 1160 - protein, 17 aa, Artificial
  CDR2 sequence
AIKSSDNSTSYRDSVKG

SEQ ID NO: 1161 - protein, 16 aa, Artificial
  CDR2 sequence
AVTSGGITNYADSVKG

SEQ ID NO: 1162 - protein, 17 aa, Artificial
  CDR2 sequence
ASRWSGGIKYHADSVKG

SEQ ID NO: 1163 - protein, 17 aa, Artificial
  CDR2 sequence
AIRWSGSATDYSDSVKG

SEQ ID NO: 1164 - protein, 16 aa, Artificial
  CDR2 sequence
TITADGITNYADSVKG

SEQ ID NO: 1165 - protein, 16 aa, Artificial
  CDR2 sequence
AVTEGGTTSYAASVKG

SEQ ID NO: 1166 - protein, 16 aa, Artificial
  CDR2 sequence
AVTEDGSINYAESVKG

SEQ ID NO: 1167 - protein, 16 aa, Artificial
  CDR2 sequence
EITEGGIINYTDSVKG

SEQ ID NO: 1168 - protein, 16 aa, Artificial
  CDR2 sequence
LINVGGVAKYEDSVKG

SEQ ID NO: 1169 - protein, 17 aa, Artificial
  CDR2 sequence
AVSWSGGNTYYADSVKG

SEQ ID NO: 1170 - protein, 17 aa, Artificial
  CDR2 sequence
GISWSGGSTDYADSVKG

SEQ ID NO: 1171 - protein, 20 aa, Artificial
  CDR2 sequence
FVAATSWSGGSKYVADSVTG

SEQ ID NO: 1172 - protein, 17 aa, Artificial
  CDR2 sequence
ATGRRGGPTYYADSVKG

SEQ ID NO: 1173 - protein, 16 aa, Artificial
  CDR2 sequence
TITGSTGTTYADSVKG

SEQ ID NO: 1174 - protein, 17 aa, Artificial
  CDR2 sequence
AINWSGSHTDYGDSVKG

SEQ ID NO: 1175 - protein, 17 aa, Artificial
  CDR2 sequence
GITRNSGRTRYADSVKG

SEQ ID NO: 1176 - protein, 17 aa, Artificial
  CDR2 sequence
GITRNSIRTRYADSVKG

SEQ ID NO: 1177 - protein, 17 aa, Artificial
  CDR2 sequence
AINRNGATAAYADSVKG

SEQ ID NO: 1178 - protein, 19 aa, Artificial
  CDR2 sequence
TIRWTGGSSSTSYADSVKG

SEQ ID NO: 1179 - protein, 17 aa, Artificial
  CDR2 sequence
AMNWSGGSTKYAESVKG

SEQ ID NO: 1180 - protein, 17 aa, Artificial
  CDR2 sequence
AISWSQYNTKYADSVKG

SEQ ID NO: 1181 - protein, 16 aa, Artificial
  CDR2 sequence
SITYGGNINYGDPVKG

SEQ ID NO: 1182 - protein, 17 aa, Artificial
  CDR2 sequence
GVNWGGGSTKVADSVKE

SEQ ID NO: 1183 - protein, 16 aa, Artificial
  CDR2 sequence
FTRWPSITYIAEHVKG

SEQ ID NO: 1184 - protein, 16 aa, Artificial
  CDR2 sequence
AITSDHITWYADAVKG

SEQ ID NO: 1185 - protein, 16 aa, Artificial
  CDR2 sequence
TINVGGGTYYAGPVKG

SEQ ID NO: 1186 - protein, 17 aa, Artificial
  CDR2 sequence
TINRRGGNTYYADSVKG

SEQ ID NO: 1187 - protein, 18 aa, Artificial
  CDR2 sequence
TISWSGGRDTVYADSVKG

SEQ ID NO: 1188 - protein, 17 aa, Artificial
  CDR2 sequence
CIESGDGTTTYVDSVKG

SEQ ID NO: 1189 - protein, 17 aa, Artificial
  CDR2 sequence
AINWSGGTTSFGDSVKG

SEQ ID NO: 1190 - protein, 17 aa, Artificial
  CDR2 sequence
AIRWSGGITWYAESVKS

SEQ ID NO: 1191 - protein, 17 aa, Artificial
  CDR2 sequence
AVRWSGGITWYAESVKG

SEQ ID NO: 1192 - protein, 17 aa, Artificial
  CDR2 sequence
TISRSGGRTSYADSVKG

SEQ ID NO: 1193 - protein, 17 aa, Artificial
  CDR2 sequence
TISRSGGRTSYADSVKG

SEQ ID NO: 1194 - protein, 15 aa, Artificial
  CDR2 sequence
RIAGGSTNYADSVKG

SEQ ID NO: 1195 - protein, 17 aa, Artificial
  CDR2 sequence
AIDWDGSRTQYADSVKG

SEQ ID NO: 1196 - protein, 17 aa, Artificial
  CDR2 sequence
TITWSGDSTYVTDSVKG

SEQ ID NO: 1197 - protein, 17 aa, Artificial
  CDR2 sequence
AINLSSGSTYYPDSVKG

SEQ ID NO: 1198 - protein, 17 aa, Artificial
  CDR2 sequence
AISRSGESTYFADSMKG

SEQ ID NO: 1199 - protein, 17 aa, Artificial
  CDR2 sequence
GISWDGGSTFYANSVKG

SEQ ID NO: 1200 - protein, 16 aa, Artificial
  CDR2 sequence
RIISDDSTLYADSVKG

SEQ ID NO: 1201 - protein, 17 aa, Artificial
  CDR2 sequence
TINWSGSHTDYADSVKG

SEQ ID NO: 1202 - protein, 17 aa, Artificial
  CDR2 sequence
AINWSGTHTDYADSVKG

SEQ ID NO: 1203 - protein, 16 aa, Artificial
  CDR2 sequence
AVGWYGSTYFADSVKG

SEQ ID NO: 1204 - protein, 16 aa, Artificial
  CDR2 sequence
LISAGDSTYYPDSVKG

SEQ ID NO: 1205 - protein, 17 aa, Artificial
  CDR2 sequence
AISWTGGSSYYGDSVKG

SEQ ID NO: 1206 - protein, 17 aa, Artificial
  CDR2 sequence
AINWSGSHRDYADSAKG

SEQ ID NO: 1207 - protein, 17 aa, Artificial
  CDR2 sequence
AINWSGGYTDYADSVKG

SEQ ID NO: 1208 - protein, 17 aa, Artificial
  CDR2 sequence
ATTRSGGLPYYSDSVKG

SEQ ID NO: 1209 - protein, 16 aa, Artificial
  CDR2 sequence
YIGTAGATHYADSVKG

SEQ ID NO: 1210 - protein, 16 aa, Artificial
  CDR2 sequence
TIIGDGRTHYADSVKD

SEQ ID NO: 1211 - protein, 17 aa, Artificial
  CDR2 sequence
SINWSGTHTYDADFVKG

SEQ ID NO: 1212 - protein, 17 aa, Artificial
  CDR2 sequence
TINWSGSHSDYADSVKG

SEQ ID NO: 1213 - protein, 16 aa, Artificial
  CDR2 sequence
GINWSGRTYYVDSVKG

SEQ ID NO: 1214 - protein, 26 aa, Artificial
  CDR2 sequence
AIRGSGGSTYIADPARSTYYADFVKG

SEQ ID NO: 1215 - protein, 17 aa, Artificial
  CDR2 sequence
ALSKDGARTYYAASVKG

SEQ ID NO: 1216 - protein, 17 aa, Artificial
  CDR2 sequence
TIRWSGSATFYSDSVKG

SEQ ID NO: 1217 - protein, 17 aa, Artificial
  CDR2 sequence
AISSSGVTTIYADSVRG

SEQ ID NO: 1218 - protein, 15 aa, Artificial
  CDR2 sequence
IVTDGFTNYADFAKG

SEQ ID NO: 1219 - protein, 15 aa, Artificial
  CDR2 sequence
IVTDGFTNYADFAKG

SEQ ID NO: 1220 - protein, 16 aa, Artificial
  CDR2 sequence
DISFGGNTNYANSVKG

SEQ ID NO: 1221 - protein, 17 aa, Artificial
  CDR2 sequence
CIANSEGTKYYADSAQG

SEQ ID NO: 1222 - protein, 17 aa, Artificial
  CDR2 sequence
SINSDGDTTYYADSVKG

SEQ ID NO: 1223 - protein, 17 aa, Artificial
  CDR2 sequence
AISRDGAATYYTDSVKG

SEQ ID NO: 1224 - protein, 18 aa, Artificial
  CDR2 sequence
CITPHHGGIIFTRESVKG

SEQ ID NO: 1225 - protein, 16 aa, Artificial
  CDR2 sequence
AVTSGGGTNYATSVKG

SEQ ID NO: 1226 - protein, 32 aa, Artificial
  FR3 sequence
RFTISRDNAKNTLFLQMNSLNPEDTAVYYCGQ

SEQ ID NO: 1227 - protein, 32 aa, Artificial
  FR3 sequence
RFTISRDNAKNTLFLQMNSLSPEDTAVYYCNQ

SEQ ID NO: 1228 - protein, 32 aa, Artificial
  FR3 sequence
RFTISRDNAKNTLFLQMNNLTPEDTAVYYCNR

SEQ ID NO: 1229 - protein, 32 aa, Artificial
  FR3 sequence
RFTISRDNAKNTLFLQMNNLRSEDTAVYSCNQ

SEQ ID NO: 1230 - protein, 32 aa, Artificial
  FR3 sequence
RFTISRDNAKNTLFLQMNSLRSEDTAVYYCNQ

SEQ ID NO: 1231 - protein, 32 aa, Artificial; identical to SEQ ID NO: 1230
  FR3 sequence

SEQ ID NO: 1232 - protein, 32 aa, Artificial; identical to SEQ ID NO: 1230
  FR3 sequence

SEQ ID NO: 1233 - protein, 32 aa, Artificial
  FR3 sequence
RFTISRDNAKNTVYLEMNSLTPEDTAVYYCNQ

SEQ ID NO: 1234 - protein, 32 aa, Artificial; identical to SEQ ID NO: 1230
  FR3 sequence

SEQ ID NO: 1235 - protein, 32 aa, Artificial; identical to SEQ ID NO: 1230
  FR3 sequence

SEQ ID NO: 1236 - protein, 32 aa, Artificial
  FR3 sequence
RFTISRDNAKNTLFLQMNSLTPEDTAVYYCNQ

SEQ ID NO: 1237 - protein, 32 aa, Artificial; identical to SEQ ID NO: 1236
  FR3 sequence

SEQ ID NO: 1238 - protein, 32 aa, Artificial
  FR3 sequence
RFTISRDNARNTLFLQMNSLTPEDTAIYYCNQ

SEQ ID NO: 1239 - protein, 32 aa, Artificial; identical to SEQ ID NO: 1227
  FR3 sequence

SEQ ID NO: 1240 - protein, 32 aa, Artificial; identical to SEQ ID NO: 1227
  FR3 sequence

SEQ ID NO: 1241 - protein, 32 aa, Artificial
  FR3 sequence
RFTISRDNAKNTLFLQMNSLSPEDTAVYYCNR

SEQ ID NO: 1242 - protein, 32 aa, Artificial; identical to SEQ ID NO: 1236
  FR3 sequence

SEQ ID NO: 1243 - protein, 32 aa, Artificial
  FR3 sequence
RFVISRDNAKNTLFLQMNSLSPEDTAVYYCNQ

SEQ ID NO: 1244 - protein, 32 aa, Artificial; identical to SEQ ID NO: 1236
  FR3 sequence

SEQ ID NO: 1245 - protein, 32 aa, Artificial; identical to SEQ ID NO: 1236
  FR3 sequence

SEQ ID NO: 1246 - protein, 32 aa, Artificial; identical to SEQ ID NO: 1236
  FR3 sequence

SEQ ID NO: 1247 - protein, 32 aa, Artificial
  FR3 sequence
RFTISRDNAKNTLFLQMNNLTPEDTAVYYCNQ

SEQ ID NO: 1248 - protein, 32 aa, Artificial; identical to SEQ ID NO: 1243
  FR3 sequence

SEQ ID NO: 1249 - protein, 32 aa, Artificial
  FR3 sequence
RFTISRDNAKNTLFLQMNSLSPEDTAVYYCNK

SEQ ID NO: 1250 - protein, 32 aa, Artificial
  FR3 sequence
RFTISRDNAKNTLFLQMNSLNPEDTAVYYCNQ

SEQ ID NO: 1251 - protein, 32 aa, Artificial; identical to SEQ ID NO: 1236
  FR3 sequence

SEQ ID NO: 1252 - protein, 32 aa, Artificial; identical to SEQ ID NO: 1236
  FR3 sequence

SEQ ID NO: 1253 - protein, 32 aa, Artificial
  FR3 sequence
RFTISRDNAKNTLFLQMNSLTPENTAVYYCNQ

SEQ ID NO: 1254 - protein, 32 aa, Artificial
  FR3 sequence
RFTISRDNAKNTLFLHMNNLSPEDTAVYYCGQ

SEQ ID NO: 1255 - protein, 32 aa, Artificial; identical to SEQ ID NO: 1236
  FR3 sequence

SEQ ID NO: 1256 - protein, 32 aa, Artificial; identical to SEQ ID NO: 1227
  FR3 sequence

SEQ ID NO: 1257 - protein, 32 aa, Artificial
  FR3 sequence
RFTISRDNAKKTVYLQMNSLQSEDTAVYYCGT

SEQ ID NO: 1258 - protein, 32 aa, Artificial
  FR3 sequence
RFTISRDNNKKTVYLQMNSLKSEDTAVYYCAT

SEQ ID NO: 1259 - protein, 32 aa, Artificial; identical to SEQ ID NO: 1257
  FR3 sequence

SEQ ID NO: 1260 - protein, 32 aa, Artificial
  FR3 sequence
RFTISRDNAKKTLYLQMNSLKSEDTAVYYCAT

SEQ ID NO: 1261 - protein, 32 aa, Artificial
  FR3 sequence
RFTISRNNANNTLYLQMNNLKFEDTAVYYCAK

SEQ ID NO: 1262 - protein, 32 aa, Artificial; identical to SEQ ID NO: 1261
  FR3 sequence

SEQ ID NO: 1263 - protein, 32 aa, Artificial
  FR3 sequence
RFTISRNNANNTLYLQMNSLKSEDTAVYYCAK

SEQ ID NO: 1264 - protein, 32 aa, Artificial; identical to SEQ ID NO: 1261
  FR3 sequence

SEQ ID NO: 1265 - protein, 32 aa, Artificial; identical to SEQ ID NO: 1263
  FR3 sequence

SEQ ID NO: 1266 - protein, 32 aa, Artificial
  FR3 sequence
RFTISRNNANNMLYLQMNSLKSEDTAVYYCAK

SEQ ID NO: 1267 - protein, 32 aa, Artificial; identical to SEQ ID NO: 1261
  FR3 sequence

SEQ ID NO: 1268 - protein, 32 aa, Artificial
  FR3 sequence
RFTISRNNANNTLYLQMNSLKSDDTAVYYCAK

SEQ ID NO: 1269 - protein, 32 aa, Artificial; identical to SEQ ID NO: 1263
  FR3 sequence

SEQ ID NO: 1270 - protein, 32 aa, Artificial; identical to SEQ ID NO: 1263
  FR3 sequence

SEQ ID NO: 1271 - protein, 32 aa, Artificial; identical to SEQ ID NO: 1263
  FR3 sequence

SEQ ID NO: 1272 - protein, 32 aa, Artificial; identical to SEQ ID NO: 1268
  FR3 sequence

SEQ ID NO: 1273 - protein, 32 aa, Artificial; identical to SEQ ID NO: 1263
  FR3 sequence

SEQ ID NO: 1274 - protein, 32 aa, Artificial; identical to SEQ ID NO: 1263
  FR3 sequence

SEQ ID NO: 1275 - protein, 32 aa, Artificial; identical to SEQ ID NO: 1263
  FR3 sequence

SEQ ID NO: 1276 - protein, 32 aa, Artificial; identical to SEQ ID NO: 1263
  FR3 sequence

SEQ ID NO: 1277 - protein, 32 aa, Artificial; identical to SEQ ID NO: 1268
  FR3 sequence

SEQ ID NO: 1278 - protein, 32 aa, Artificial; identical to SEQ ID NO: 1263
  FR3 sequence

SEQ ID NO: 1279 - protein, 32 aa, Artificial; identical to SEQ ID NO: 1263
  FR3 sequence

SEQ ID NO: 1280 - protein, 32 aa, Artificial; identical to SEQ ID NO: 1263
  FR3 sequence

SEQ ID NO: 1281 - protein, 32 aa, Artificial; identical to SEQ ID NO: 1263
  FR3 sequence

SEQ ID NO: 1282 - protein, 32 aa, Artificial; identical to SEQ ID NO: 1268
  FR3 sequence

SEQ ID NO: 1283 - protein, 32 aa, Artificial; identical to SEQ ID NO: 1263
  FR3 sequence

SEQ ID NO: 1284 - protein, 32 aa, Artificial; identical to SEQ ID NO: 1263
  FR3 sequence

SEQ ID NO: 1285 - protein, 32 aa, Artificial; identical to SEQ ID NO: 1268
  FR3 sequence

SEQ ID NO: 1286 - protein, 32 aa, Artificial; identical to SEQ ID NO: 1263
  FR3 sequence

SEQ ID NO: 1287 - protein, 32 aa, Artificial
  FR3 sequence
RFTISRDNAKNTVYLQMNSLKPEDTAVYYCKR

SEQ ID NO: 1288 - protein, 32 aa, Artificial
  FR3 sequence
RFTISRDNAKNTLHLQMNSLKPEDTAVYYCAY

SEQ ID NO: 1289 - protein, 32 aa, Artificial
  FR3 sequence
RFTISRVNAKDTVYLQMNSLKPEDTAVYYCYM

SEQ ID NO: 1290 - protein, 32 aa, Artificial
  FR3 sequence
RFTISRDNAKKTVYLQMNSLKPEDTARYYCGV

SEQ ID NO: 1291 - protein, 32 aa, Artificial
  FR3 sequence
RFTISRDNAKETVYLQMNSLKPDDTGVYYCAA

SEQ ID NO: 1292 - protein, 32 aa, Artificial
  FR3 sequence
RFTISRDNAKETVYLQMNSLKPEDTGVYYCAA

SEQ ID NO: 1293 - protein, 32 aa, Artificial; identical to SEQ ID NO: 1291
  FR3 sequence

SEQ ID NO: 1294 - protein, 32 aa, Artificial; identical to SEQ ID NO: 1291
  FR3 sequence

SEQ ID NO: 1295 - protein, 32 aa, Artificial
  FR3 sequence
RFTISRDNAKKTVYLQMNSLKPEDTAVYYCAT

SEQ ID NO: 1296 - protein, 32 aa, Artificial
  FR3 sequence
RFTISRDNAKKTAYLQMNSLKPEDTAVYYCAA

SEQ ID NO: 1297 - protein, 32 aa, Artificial; identical to SEQ ID NO: 1296
  FR3 sequence

SEQ ID NO: 1298 - protein, 32 aa, Artificial; identical to SEQ ID NO: 1295
  FR3 sequence

SEQ ID NO: 1299 - protein, 32 aa, Artificial
  FR3 sequence
RFTISRDNAKKTVYLQMNSLKPEDTAVYYCAA

SEQ ID NO: 1300 - protein, 32 aa, Artificial; identical to SEQ ID NO: 1299
  FR3 sequence

SEQ ID NO: 1301 - protein, 32 aa, Artificial; identical to SEQ ID NO: 1299
  FR3 sequence

SEQ ID NO: 1302 - protein, 32 aa, Artificial
  FR3 sequence
RFTMARDNANHTVHLQMNSLKPEDTAVYYCNA

SEQ ID NO: 1303 - protein, 32 aa, Artificial
  FR3 sequence
RFTVSRDIAENTVYLQMNTLKSEDTAVYYCAA

SEQ ID NO: 1304 - protein, 32 aa, Artificial
  FR3 sequence
RFTISSDNAKNTVYLQMNSLKPEDTAVYYCAA

SEQ ID NO: 1305 - protein, 32 aa, Artificial
  FR3 sequence
RFTISRDNAKNTLYLQMSSLKPEDTALYYCTK

SEQ ID NO: 1306 - protein, 32 aa, Artificial
  FR3 sequence
RFTISRDNAKNTLYLQMNSLKPEDTAVYYCAA

SEQ ID NO: 1307 - protein, 32 aa, Artificial
  FR3 sequence
RFTVSRDNANNTVYLQMNTLKPEDTAVYYCRD

SEQ ID NO: 1308 - protein, 32 aa, Artificial
  FR3 sequence
RFTVSRDNAKNTVYLQMNSLKAEDTAVYYCWD

SEQ ID NO: 1309 - protein, 32 aa, Artificial; identical to SEQ ID NO: 1307
  FR3 sequence

SEQ ID NO: 1310 - protein, 32 aa, Artificial
  FR3 sequence
RFTVSRDNDKNTLYLQMNSLKPEDTAVYYCRD

SEQ ID NO: 1311 - protein, 32 aa, Artificial; identical to SEQ ID NO: 1307
  FR3 sequence

SEQ ID NO: 1312 - protein, 32 aa, Artificial
  FR3 sequence
RFTVSRDNAKNTLYLQMNSLKPEDTATYLCRD

SEQ ID NO: 1313 - protein, 32 aa, Artificial
  FR3 sequence
RFTVSRDNAKNTLYLQMNSLEPEDTATYYCWD

SEQ ID NO: 1314 - protein, 32 aa, Artificial
  FR3 sequence
RFTVSRDNAKNTLYLRMNSLKSEDSATYTCRA

SEQ ID NO: 1315 - protein, 32 aa, Artificial
  FR3 sequence
RFTVSRDNAKNTVYLQMNSLKPEDTAVYYCRD

SEQ ID NO: 1316 - protein, 32 aa, Artificial
  FR3 sequence
RFTVSRDNANHTVYLQMNSLKPEDTAVYYCRD

SEQ ID NO: 1317 - protein, 32 aa, Artificial; identical to SEQ ID NO: 1315
  FR3 sequence

SEQ ID NO: 1318 - protein, 32 aa, Artificial; identical to SEQ ID NO: 1315
  FR3 sequence

SEQ ID NO: 1319 - protein, 32 aa, Artificial
  FR3 sequence
RFTVSRDNAKNTLYLQMNSLKPEDTAVYYCWD

SEQ ID NO: 1320 - protein, 32 aa, Artificial
  FR3 sequence
RFAISRDNAKNTAYLQMNSLKAEDTAVYYCNA

SEQ ID NO: 1321 - protein, 32 aa, Artificial; identical to SEQ ID NO: 1302
  FR3 sequence

SEQ ID NO: 1322 - protein, 32 aa, Artificial; identical to SEQ ID NO: 1302
  FR3 sequence

SEQ ID NO: 1323 - protein, 32 aa, Artificial
  FR3 sequence
RFTISRDNAENTVYLQMNSLKPEDTAVYYCWD

SEQ ID NO: 1324 - protein, 32 aa, Artificial
  FR3 sequence
RFTISRDNAKNTVYLQINSLKPEDTAVYYCWD

SEQ ID NO: 1325 - protein, 32 aa, Artificial
  FR3 sequence
RFTISRDNAKKTMYLQMNSLKPDDTAVYYCRD

SEQ ID NO: 1326 - protein, 32 aa, Artificial
  FR3 sequence
RFTVSRDNAENTVYLQMNSLKPEDTAVYYCRD

SEQ ID NO: 1327 - protein, 32 aa, Artificial
  FR3 sequence
RFTLSRDNAKNTVYLQMNSLKPEDTAVYYCRD

SEQ ID NO: 1328 - protein, 32 aa, Artificial; identical to SEQ ID NO: 1323
  FR3 sequence

SEQ ID NO: 1329 - protein, 32 aa, Artificial
  FR3 sequence
RFTLSRHNAENTVYLQMNSLKPEDTAVYYCRD

SEQ ID NO: 1330 - protein, 32 aa, Artificial
  FR3 sequence
RFTISSDNAKSTIYLQMNSLKPDDTAVYYCRD

SEQ ID NO: 1331 - protein, 32 aa, Artificial
  FR3 sequence
RFTISSDNAKNTIYLQMNSLKPDDTAVYYCRD

SEQ ID NO: 1332 - protein, 32 aa, Artificial
  FR3 sequence
RFTISRDNAKKTVYLQMNSLKPEDTAVYYCRD

SEQ ID NO: 1333 - protein, 32 aa, Artificial
  FR3 sequence
RFTISRDGATNTVFLQMNNLKPEDTAVYYCRD

SEQ ID NO: 1334 - protein, 32 aa, Artificial; identical to SEQ ID NO: 1326
  FR3 sequence

SEQ ID NO: 1335 - protein, 32 aa, Artificial
  FR3 sequence
RFTVSRDNADNTVYLQMNSLKPEDTAVYYCRD

SEQ ID NO: 1336 - protein, 32 aa, Artificial
  FR3 sequence
RFTISSDNAKSTIYLQMNSLEPDDTAVYYCRD

SEQ ID NO: 1337 - protein, 32 aa, Artificial
  FR3 sequence
RFTISSDNAKKTIYLQMNSLKPDDTAVYYCRD

SEQ ID NO: 1338 - protein, 32 aa, Artificial; identical to SEQ ID NO: 1330
  FR3 sequence

SEQ ID NO: 1339 - protein, 32 aa, Artificial
  FR3 sequence
RFTISRDNAKNAVILQMNNLKTEDTAVYYCAA

SEQ ID NO: 1340 - protein, 32 aa, Artificial; identical to SEQ ID NO: 1339
  FR3 sequence

SEQ ID NO: 1341 - protein, 32 aa, Artificial
  FR3 sequence
RFTISNDNAKDTVYLQMNSLKSEDTAVYYCRN

SEQ ID NO: 1342 - protein, 32 aa, Artificial
  FR3 sequence
RFTISRDNAKNTVYLQMNSLKPEDTGVYYCRD

SEQ ID NO: 1343 - protein, 32 aa, Artificial
  FR3 sequence
RFTISKDYTRNTVYLQVNSLKPEDTAVYHCAT

SEQ ID NO: 1344 - protein, 32 aa, Artificial
  FR3 sequence
RFTISGDTAKSTLYLQMNSLKPEDTAMYYCYG

SEQ ID NO: 1345 - protein, 32 aa, Artificial
  FR3 sequence
RFAISRDNAKNTVYLQMNSLKPEDTAVYYCRD

SEQ ID NO: 1346 - protein, 32 aa, Artificial
  FR3 sequence
RFAISRDNAKNMVYLQMNTLKPEDTAVYYCRD

SEQ ID NO: 1347 - protein, 32 aa, Artificial; identical to SEQ ID NO: 1345
  FR3 sequence

SEQ ID NO: 1348 - protein, 32 aa, Artificial
  FR3 sequence
RFAISRDNAKNTVYLQMNTLKPEDTAVYYCRD

SEQ ID NO: 1349 - protein, 32 aa, Artificial
  FR3 sequence
RFAISRDNAKNTVYLQMRSLKPEDTAVYYCRD

SEQ ID NO: 1350 - protein, 32 aa, Artificial
  FR3 sequence
RFTISRDNAKNTVYLQMNSLKPEDTAVYYCRD

SEQ ID NO: 1351 - protein, 32 aa, Artificial
  FR3 sequence
RFTISRDNAKNTVYLQMNNLKPEDTAVYYCRD

SEQ ID NO: 1352 - protein, 32 aa, Artificial
  FR3 sequence
RFTISRDNAKKTVYLQMNSLKPEDTAVYFCRD

SEQ ID NO: 1353 - protein, 32 aa, Artificial
  FR3 sequence
RFTFSKDGAKNTVYLQMNSLKPEDTAVYYCRD

SEQ ID NO: 1354 - protein, 32 aa, Artificial; identical to SEQ ID NO: 1350
  FR3 sequence

SEQ ID NO: 1355 - protein, 32 aa, Artificial
  FR3 sequence
RFTLSRDNAKKTVYLQMNSLKPEDTAIYYCRD

SEQ ID NO: 1356 - protein, 34 aa, Artificial
  FR3 sequence
RFTISISRDNVEYTVDLQMDSLKPEDTAVYYCRD

SEQ ID NO: 1357 - protein, 32 aa, Artificial
  FR3 sequence
RFTISRDNAKNTVYLQVNSLKPEDTAVYYCWD

SEQ ID NO: 1358 - protein, 32 aa, Artificial
  FR3 sequence
RFTISRDNAKNTLYLQMNSLKPEDTALYYCTK

SEQ ID NO: 1359 - protein, 32 aa, Artificial
  FR3 sequence
RFTISRDNAKNTVYLEMNSLKPEDTGVYYCNG

SEQ ID NO: 1360 - protein, 32 aa, Artificial; identical to SEQ ID NO: 1359
  FR3 sequence

SEQ ID NO: 1361 - protein, 32 aa, Artificial
  FR3 sequence
RFTISRDNTKNTLDLQMNSLKPEDTAVYYCHG

SEQ ID NO: 1362 - protein, 32 aa, Artificial
  FR3 sequence
RFTISRDNAKNTVVLQMNGLKPEDTAVYYCKG

SEQ ID NO: 1363 - protein, 32 aa, Artificial
  FR3 sequence
RFTISRDNAKNTVYLQMNDLKPEDTAVYYCNG

SEQ ID NO: 1364 - protein, 32 aa, Artificial
  FR3 sequence
RFTIARDNAKNTVSLQMNSLKPEDTAVYYCNL

SEQ ID NO: 1365 - protein, 32 aa, Artificial
  FR3 sequence
RFTISRDNTKNTMYLQMVSLKPEDTAVYYCNV

SEQ ID NO: 1366 - protein, 32 aa, Artificial
  FR3 sequence
RFTISRDNAKNTVYLQMASLKPEDTAAYYCAA

SEQ ID NO: 1367 - protein, 32 aa, Artificial
  FR3 sequence
RFTISRDNVKNTLYLQMNSLKSEDTAVYYCAK

SEQ ID NO: 1368 - protein, 32 aa, Artificial
  FR3 sequence
RFTISRDNAKNTVYLQMNSLKPEDTAVYYCAT

SEQ ID NO: 1369 - protein, 32 aa, Artificial
  FR3 sequence
RFTISRDNAKNAVHLQMNSLRLEDTAVYYCNA

SEQ ID NO: 1370 - protein, 32 aa, Artificial
  FR3 sequence
RFTISRDNPETAVHLQMNSLKLEDTAVYYCNA

SEQ ID NO: 1371 - protein, 32 aa, Artificial
  FR3 sequence
RFTISRDNARDTLFLQMHALQPEDTAVYMCNL

SEQ ID NO: 1372 - protein, 32 aa, Artificial
  FR3 sequence
RFTISRDNAKNTLYLQMSSLKPEDTALYYCAK

SEQ ID NO: 1373 - protein, 32 aa, Artificial
  FR3 sequence
RFTISTDNAKNTLYLQMSSLKPEDTALYYCAK

SEQ ID NO: 1374 - protein, 32 aa, Artificial; identical to SEQ ID NO: 1368
  FR3 sequence

SEQ ID NO: 1375 - protein, 32 aa, Artificial
  FR3 sequence
RFTISRDNAKKTLYLQMNSLQSEDTAVYYCAK

SEQ ID NO: 1376 - protein, 32 aa, Artificial; identical to SEQ ID NO: 1350
  FR3 sequence

SEQ ID NO: 1377 - protein, 32 aa, Artificial; identical to SEQ ID NO: 1350
  FR3 sequence

SEQ ID NO: 1378 - protein, 32 aa, Artificial; identical to SEQ ID NO: 1350
  FR3 sequence

SEQ ID NO: 1379 - protein, 32 aa, Artificial; identical to SEQ ID NO: 1350
  FR3 sequence

SEQ ID NO: 1380 - protein, 32 aa, Artificial
  FR3 sequence
RFTISRDNAKNTVYLQMNSLKPEDTAVYYCAS

SEQ ID NO: 1381 - protein, 32 aa, Artificial
  FR3 sequence
RFTISRDNAKNTLYLQMNSLKPEDTAVYYCAR

SEQ ID NO: 1382 - protein, 32 aa, Artificial
  FR3 sequence
RFTTSRDNAKNTVYLQMNDLKPEDTAVYYCAA

SEQ ID NO: 1383 - protein, 32 aa, Artificial; identical to SEQ ID NO: 112
  FR3 sequence

SEQ ID NO: 1384 - protein, 32 aa, Artificial
  FR3 sequence
RFTISRANAKNTVYLQMNGLKPEDTAVYYCAA

SEQ ID NO: 1385 - protein, 32 aa, Artificial
  FR3 sequence
RFTISRDNAKITVYLQMNSLKPEDTAVYYCAA

SEQ ID NO: 1386 - protein, 32 aa, Artificial; identical to SEQ ID NO: 112
  FR3 sequence

SEQ ID NO: 1387 - protein, 32 aa, Artificial; identical to SEQ ID NO: 112
  FR3 sequence

SEQ ID NO: 1388 - protein, 32 aa, Artificial
  FR3 sequence
RFTISRDNAKNTVYLQMNSLSPEDTAVYYCAA

SEQ ID NO: 1389 - protein, 32 aa, Artificial; identical to SEQ ID NO: 112
  FR3 sequence

SEQ ID NO: 1390 - protein, 32 aa, Artificial
  FR3 sequence
RFTISRDSAKNAVNLQMELVESDDTAVYYCAA

SEQ ID NO: 1391 - protein, 32 aa, Artificial
  FR3 sequence
RFTISRDSAKNTVYLQMDSLKPEDTAVYVCNA

SEQ ID NO: 1392 - protein, 32 aa, Artificial
  FR3 sequence
RFTISRDNAKNSVYLQMNSLKPEDTAIYYCAA

SEQ ID NO: 1393 - protein, 32 aa, Artificial
  FR3 sequence
RFTISRDNAKNTVYLQMNSLKPEDTAVYYCGA

SEQ ID NO: 1394 - protein, 32 aa, Artificial; identical to SEQ ID NO: 1393
  FR3 sequence

SEQ ID NO: 1395 - protein, 32 aa, Artificial
  FR3 sequence
RFTIARDDAKNTMYLQMNGMKPEDTAVYYCKM

SEQ ID NO: 1396 - protein, 32 aa, Artificial
  FR3 sequence
RFDISRDNAKNTVYLQMNRLKPEDTAVYYCAA

SEQ ID NO: 1397 - protein, 32 aa, Artificial
  FR3 sequence
RFAISRDNALNTVYLQMNSLKPEDTAVYYCAA

SEQ ID NO: 1398 - protein, 32 aa, Artificial
  FR3 sequence
RFTISRDNGKNTVDLRMNSLKPEDTAVYYCAA

SEQ ID NO: 1399 - protein, 32 aa, Artificial; identical to SEQ ID NO: 112
  FR3 sequence

SEQ ID NO: 1400 - protein, 32 aa, Artificial
  FR3 sequence
RFTISRDDAKNTVYLQMNSLKAEDTAIYYCAA

SEQ ID NO: 1401 - protein, 32 aa, Artificial
  FR3 sequence
RFTVSRDNAQNTVYLQMNSLKIEDTGVYYCNA

SEQ ID NO: 1402 - protein, 32 aa, Artificial
  FR3 sequence
RFTISGDDARNTVYLQMNSLNPEDTAVYYCNA

SEQ ID NO: 1403 - protein, 32 aa, Artificial
  FR3 sequence
RFTISRDNSENTVYFEMGSLKPEDTAVYYCAI

SEQ ID NO: 1404 - protein, 32 aa, Artificial
  FR3 sequence
RFTISRDNAKGTVYLQMSSLKPEDTAVYYCAA

SEQ ID NO: 1405 - protein, 32 aa, Artificial
  FR3 sequence
RFTISRDNTKNTVYLQMNSMRPEDTAVYYCAA

SEQ ID NO: 1406 - protein, 32 aa, Artificial
  FR3 sequence
RFTISRDIANDVVYLQMNSLEPEDTAVYYCAR

SEQ ID NO: 1407 - protein, 32 aa, Artificial
  FR3 sequence
RFTISRDNAKNTLYLQTTSLRPEDTGVYYCAE

SEQ ID NO: 1408 - protein, 32 aa, Artificial
  FR3 sequence
RFTISKDNAKNTVYLQMNSLKPEDTAVYYCAA

SEQ ID NO: 1409 - protein, 32 aa, Artificial; identical to SEQ ID NO: 112
  FR3 sequence

SEQ ID NO: 1410 - protein, 32 aa, Artificial
  FR3 sequence
RFTISRDYAKNTWYLQMNTLKPEDTAAYYCAA

SEQ ID NO: 1411 - protein, 32 aa, Artificial
  FR3 sequence
RFTISRDNAKNTVQLQMNSLKPEDTAVYYCAV

SEQ ID NO: 1412 - protein, 32 aa, Artificial
  FR3 sequence
RFTISRDNAKNTVYLQMTSLMPEDTAVYYCAD

SEQ ID NO: 1413 - protein, 32 aa, Artificial; identical to SEQ ID NO: 112
  FR3 sequence

SEQ ID NO: 1414 - protein, 32 aa, Artificial
  FR3 sequence
RFTISRDNAKDTMYLQMNVLKPEDTAVYYCAA

SEQ ID NO: 1415 - protein, 32 aa, Artificial
  FR3 sequence
RFTISRDNAKNTVYLRMNSLKPEDTAVYYCAT

SEQ ID NO: 1416 - protein, 32 aa, Artificial
  FR3 sequence
RFTISRDDAKNTVYLQMNSLKPEDTAVYLCAA

SEQ ID NO: 1417 - protein, 32 aa, Artificial
  FR3 sequence
RVTISRDDAKNTVYLRMNSLKPEDTAVYYCAA

SEQ ID NO: 1418 - protein, 32 aa, Artificial
  FR3 sequence
RFTISRDDAKNTVYLRMNSLKPEDTAVYYCAA

SEQ ID NO: 1419 - protein, 32 aa, Artificial
  FR3 sequence
RFTISRDNAKNTVYLRMNSLKPEDTAVYYCAA

SEQ ID NO: 1420 - protein, 32 aa, Artificial
  FR3 sequence
RFTIARDDAKNTVYLQMNSLKPEDTAVYYCAL

SEQ ID NO: 1421 - protein, 32 aa, Artificial
  FR3 sequence
RFTISRDNAKNTLYLQMNSLKPEDTAVYYCAK

SEQ ID NO: 1422 - protein, 32 aa, Artificial
  FR3 sequence
RFTISRDNAKNGVSLQMDSLKAEDTAVYYCAS

SEQ ID NO: 1423 - protein, 32 aa, Artificial
  FR3 sequence
RFTISSDNAKNTVYLQMNSLKPEDTALYYCAR

SEQ ID NO: 1424 - protein, 32 aa, Artificial
  FR3 sequence
RFTISRDDAKNTVYLQMNSLKPEDTAVYYCAA

SEQ ID NO: 1425 - protein, 32 aa, Artificial
  FR3 sequence
RFTISIDNAKNTVYLQMNNLTPEDTAVYYCAA

SEQ ID NO: 1426 - protein, 32 aa, Artificial
  FR3 sequence
RFTISRDNAKNTVYLQMDSLKPEDTAVYYCAA

SEQ ID NO: 1427 - protein, 32 aa, Artificial
  FR3 sequence
RFTISKENAKNTVYLQMTILKPEDTAVYYCAS

SEQ ID NO: 1428 - protein, 32 aa, Artificial
  FR3 sequence
RFTISRDSAKDTVYLQMNNLKPEDTAVYYCAA

SEQ ID NO: 1429 - protein, 32 aa, Artificial
  FR3 sequence
RFTISRDNAKNAVNLQMSNLKPEDTALHYCTI

SEQ ID NO: 1430 - protein, 32 aa, Artificial
  FR3 sequence
RFTISRDNARNAVNPQMNNLKPEDTAVYYCTI

SEQ ID NO: 1431 - protein, 32 aa, Artificial
  FR3 sequence
RFTISRDNAKNAVYLQMNSLKPEDTAVYYCAA

SEQ ID NO: 1432 - protein, 32 aa, Artificial
  FR3 sequence
RFTISRDNAKNAVNLQMSNLKPEDTALYYCTI

SEQ ID NO: 1433 - protein, 32 aa, Artificial
  FR3 sequence
RFTISRSIAENTVYLQMNKVKPEDTAVYYCAA

SEQ ID NO: 1434 - protein, 32 aa, Artificial
  FR3 sequence
RFTISRDNAKNTVYLQMNSLKPEDTAVYYCNA

SEQ ID NO: 1435 - protein, 32 aa, Artificial
  FR3 sequence
RFTISRDNAKSTMYLQMNSLKPEDTAVYYCAA

SEQ ID NO: 1436 - protein, 32 aa, Artificial
  FR3 sequence
RFTISRDNAKNTLYLQMNSLKAEDTAVYYCNA

SEQ ID NO: 1437 - protein, 32 aa, Artificial
  FR3 sequence
RFTISRDDAKNSIYLQMNTLKPEDTAVYYCAA

SEQ ID NO: 1438 - protein, 32 aa, Artificial
  FR3 sequence
RFTISRDNAKNTVYLQMNSLIPEDTAVYYCAA

SEQ ID NO: 1439 - protein, 32 aa, Artificial
  FR3 sequence
RFTVSRDNGRNTVYLQMNSLKPEDTAVYYCNV

SEQ ID NO: 1440 - protein, 32 aa, Artificial
  FR3 sequence
RFTISRDKAKNTVLLQMDSLKPEDTAVYYCNA

SEQ ID NO: 1441 - protein, 32 aa, Artificial
  FR3 sequence
RFTISRDKAKNALYLQMNSLKPEDMAVYYCNA

SEQ ID NO: 1442 - protein, 32 aa, Artificial
  FR3 sequence
RFTISRDNAKNTVYLEMNNLKPEDTAVYYCNA

SEQ ID NO: 1443 - protein, 32 aa, Artificial
  FR3 sequence
RFTISRDNAENTVYLQMNNLKPEDMAVYYCNA

SEQ ID NO: 1444 - protein, 32 aa, Artificial
  FR3 sequence
RFTISRDNAKSTVYLQMDSLKPEDTAVYYCAA

SEQ ID NO: 1445 - protein, 32 aa, Artificial
  FR3 sequence
RFTISRDNSKNTVSLQMNSLKPEDTAVYYCAA

SEQ ID NO: 1446 - protein, 32 aa, Artificial
  FR3 sequence
RFTIFRDNAENTAYLQMNSLNPEDTAVYYCAV

SEQ ID NO: 1447 - protein, 32 aa, Artificial
  FR3 sequence
RFTISRDNAESTVYLQMNSLKAEDTAVYYCAA

SEQ ID NO: 1448 - protein, 32 aa, Artificial
  FR3 sequence
RFAISRDGAKNTVYLQMDSLKPEDTAVYYCNL

SEQ ID NO: 1449 - protein, 32 aa, Artificial
  FR3 sequence
RFAISRDNAKNTVYLQMHSLKPEDTAVYHCAT

SEQ ID NO: 1450 - protein, 32 aa, Artificial
  FR3 sequence
RFTISRDNADNTVTLQMNSLKPEDTAVYYCAG

SEQ ID NO: 1451 - protein, 32 aa, Artificial; identical to SEQ ID NO: 1450
  FR3 sequence

SEQ ID NO: 1452 - protein, 32 aa, Artificial
  FR3 sequence
RFTISRDNAEDLLYLQMNLLKPEDTAVYYCAA

SEQ ID NO: 1453 - protein, 32 aa, Artificial
  FR3 sequence
RFTISKNTAENTVYLQMNSLKPEDTAVYYCAV

SEQ ID NO: 1454 - protein, 32 aa, Artificial
  FR3 sequence
RFTISRANDNNPLYLQMNTLKPEDTAVYYCAA

SEQ ID NO: 1455 - protein, 32 aa, Artificial
  FR3 sequence
RFTISRDNAINSLYLQMDTLKPEDTAVYYCAA

SEQ ID NO: 1456 - protein, 32 aa, Artificial
  FR3 sequence
RFSISRDNALKTVYLQMNSLKPEDTAVYYCYA

SEQ ID NO: 1457 - protein, 32 aa, Artificial
  FR3 sequence
RFTISRDYDNSPVYLQMNTLKPEDTAVYYCAA

SEQ ID NO: 1458 - protein, 32 aa, Artificial
  FR3 sequence
RFTISRDNAKNTVYLQMNSLEREDTAVYYCAA

SEQ ID NO: 1459 - protein, 32 aa, Artificial
  FR3 sequence
RFTISRDNAKNTVTLQMNSLRPEDTAVYYCAA

SEQ ID NO: 1460 - protein, 32 aa, Artificial
  FR3 sequence
RFTISRDNAKNSVYLQMNSLKPEDTSVYYCNV

SEQ ID NO: 1461 - protein, 32 aa, Artificial
  FR3 sequence
RFTISRDNARNTVYLQMNSLKPEDTAVYYCAA

SEQ ID NO: 1462 - protein, 32 aa, Artificial; identical to SEQ ID NO: 112
  FR3 sequence

SEQ ID NO: 1463 - protein, 32 aa, Artificial
  FR3 sequence
RFTISRDNAKNAVYLQMNSLKPEDTGVYYCAT

SEQ ID NO: 1464 - protein, 32 aa, Artificial; identical to SEQ ID NO: 112
  FR3 sequence

SEQ ID NO: 1465 - protein, 32 aa, Artificial
  FR3 sequence
RFTISRDNTKNTIDLQINSLKPEDTAVYYCAA

SEQ ID NO: 1466 - protein, 32 aa, Artificial; identical to SEQ ID NO: 1465
  FR3 sequence

SEQ ID NO: 1467 - protein, 32 aa, Artificial
  FR3 sequence
RFIVSRDNAKNTADLQMNDLKPEDTAVYYCGA

SEQ ID NO: 1468 - protein, 32 aa, Artificial
  FR3 sequence
RFIVSRDNAKNTADLQMNELKPEDTAVYYCGA

SEQ ID NO: 1469 - protein, 32 aa, Artificial
  FR3 sequence
RFTISRDDAKNTVFLQMNSLKPEDTAVYYCNV

SEQ ID NO: 1470 - protein, 32 aa, Artificial
  FR3 sequence
RFTISRENVKDTMYLQMNSLQAEDTGVYYCVR

SEQ ID NO: 1471 - protein, 32 aa, Artificial
  FR3 sequence
RFTISRDNARNTAYLQMDSLRPEDTAVYSCAA

SEQ ID NO: 1472 - protein, 32 aa, Artificial
  FR3 sequence
RFTISRGNAKNTVNLQMNSLKPEDTAVYYCAA

SEQ ID NO: 1473 - protein, 32 aa, Artificial
  FR3 sequence
RFTISRDNTESTGYLQMNNLKPEDTAVYYCAA

SEQ ID NO: 1474 - protein, 32 aa, Artificial
  FR3 sequence
RFTISRDNAKNMVYLQMNSLKPEDTAVYYCAA

SEQ ID NO: 1475 - protein, 32 aa, Artificial
  FR3 sequence
RFTISRDYAKNTAYLQMNSLKPEDTAVYYCVA

SEQ ID NO: 1476 - protein, 32 aa, Artificial
  FR3 sequence
RFTISRDNAENTVYLQMNSLTPEDTAVYYCAS

SEQ ID NO: 1477 - protein, 32 aa, Artificial
  FR3 sequence
RFTISRDNAENTVYLLMNSLIPEDTAVYYCAT

SEQ ID NO: 1478 - protein, 32 aa, Artificial
  FR3 sequence
RFTIYRDNAQNTMYLQMNSLKPEDTAVYYCAA

SEQ ID NO: 1479 - protein, 32 aa, Artificial
  FR3 sequence
RFTVSRDNAKNTVYLQMNSLKPEDTAVYYCNA

SEQ ID NO: 1480 - protein, 32 aa, Artificial
  FR3 sequence
RSTISRENAENTVYLQMNSLKPEDTAVYYCAA

SEQ ID NO: 1481 - protein, 32 aa, Artificial
  FR3 sequence
RFTISRDNAKKTAYLQMNSLRPEDTAVYYCVG

SEQ ID NO: 1482 - protein, 32 aa, Artificial
  FR3 sequence
RFTISRDNTKNTVYLQMNSLKPEDTAVYYCRP

SEQ ID NO: 1483 - protein, 32 aa, Artificial
  FR3 sequence
RFTISRDNAKNTVDLQMSSLKPEDTAAYYCAA

SEQ ID NO: 1484 - protein, 32 aa, Artificial
  FR3 sequence
RFTISRDNAENLVYLQMNNLKPEDTAVYYCSA

SEQ ID NO: 1485 - protein, 32 aa, Artificial
  FR3 sequence
RFTISRDAAANLVYLQMNSLKPSDTAIYSCNA

SEQ ID NO: 1486 - protein, 32 aa, Artificial
  FR3 sequence
RFIISRDNAKNTVYLQINSLKPEDTAVYYCAA

SEQ ID NO: 1487 - protein, 32 aa, Artificial
  FR3 sequence
RFTISRDNAKNTVYLQMNNLKSEDTAVYYCAP

SEQ ID NO: 1488 - protein, 32 aa, Artificial
  FR3 sequence
RFTFSRDNAKNTVYLQMNSLKPEDTAIYLCAV

SEQ ID NO: 1489 - protein, 32 aa, Artificial
  FR3 sequence
RFTISRDNAKNTVYLQMNSLKPEDTAVYYCAC

SEQ ID NO: 1490 - protein, 32 aa, Artificial
  FR3 sequence
RFTIYRDNAKNVVYLQMSVLNGEDTAVYYCAA

SEQ ID NO: 1491 - protein, 32 aa, Artificial; identical to SEQ ID NO: 112
  FR3 sequence

SEQ ID NO: 1492 - protein, 32 aa, Artificial
  FR3 sequence
RFTISRDEAKNTVYLEMNSLKTDDTAVYYCAA

SEQ ID NO: 1493 - protein, 32 aa, Artificial
  FR3 sequence
RFTISRDNAKTTVYLQMNSLQPEDTARYYCRY

SEQ ID NO: 1494 - protein, 32 aa, Artificial; identical to SEQ ID NO: 1493
  FR3 sequence

SEQ ID NO: 1495 - protein, 32 aa, Artificial
  FR3 sequence
RFTISRDNAKNTVYLQMNSLKPEDTAVYYCYA

SEQ ID NO: 1496 - protein, 32 aa, Artificial
  FR3 sequence
RLPISSDNAKKTVYLQMDSLKPEDTAVYYCAA

SEQ ID NO: 1497 - protein, 32 aa, Artificial
  FR3 sequence
RFTISRDNDENMLYLQMNSLKPEDTAVYYCAT

SEQ ID NO: 1498 - protein, 32 aa, Artificial
  FR3 sequence
RFTISRDNAKNTVFLQMNSLKPEDTAIYYCAA

SEQ ID NO: 1499 - protein, 32 aa, Artificial
  FR3 sequence
RFATSSDSAKNTVYLQMHSLKPEDTAVYYCAT

SEQ ID NO: 1500 - protein, 32 aa, Artificial
  FR3 sequence
RFIISRDDSKNTVDLQMNSLKPEDTAVYYCNL

SEQ ID NO: 1501 - protein, 9 aa, Artificial
  CDR3 sequence
GWKIVPTNP

SEQ ID NO: 1502 - protein, 9 aa, Artificial
  CDR3 sequence
GWKIRPTIP

SEQ ID NO: 1503 - protein, 9 aa, Artificial
  CDR3 sequence
GWKIVPTDL

SEQ ID NO: 1504 - protein, 9 aa, Artificial
  CDR3 sequence
GWKIVPTDR

SEQ ID NO: 1505 - protein, 9 aa, Artificial
  CDR3 sequence
GWKIVPTDR

SEQ ID NO: 1506 - protein, 9 aa, Artificial
  CDR3 sequence
GWKIVPTDR

SEQ ID NO: 1507 - protein, 9 aa, Artificial
  CDR3 sequence
GWKIVPTDR

SEQ ID NO: 1508 - protein, 9 aa, Artificial
  CDR3 sequence
GWKIVPTDR

SEQ ID NO: 1509 - protein, 9 aa, Artificial
  CDR3 sequence
GWKIVPTDR

SEQ ID NO: 1510 - protein, 9 aa, Artificial
  CDR3 sequence
GWKIVPTDR

SEQ ID NO: 1511 - protein, 9 aa, Artificial
  CDR3 sequence
GWKIVPMDR

SEQ ID NO: 1512 - protein, 9 aa, Artificial
  CDR3 sequence
GWKIIPTDR

SEQ ID NO: 1513 - protein, 9 aa, Artificial
  CDR3 sequence
GWKILPTDR

SEQ ID NO: 1514 - protein, 9 aa, Artificial
  CDR3 sequence
GWKILPTNR

SEQ ID NO: 1515 - protein, 9 aa, Artificial
  CDR3 sequence
GWKILPTNR

SEQ ID NO: 1516 - protein, 9 aa, Artificial
  CDR3 sequence
GWKILPTNR

SEQ ID NO: 1517 - protein, 9 aa, Artificial
  CDR3 sequence
GWKIIPTDR

SEQ ID NO: 1518 - protein, 9 aa, Artificial
  CDR3 sequence
GWKIIPTDR

SEQ ID NO: 1519 - protein, 9 aa, Artificial
  CDR3 sequence
GWKIIPTDR

SEQ ID NO: 1520 - protein, 9 aa, Artificial
  CDR3 sequence
GWKIIPTDR

SEQ ID NO: 1521 - protein, 9 aa, Artificial
  CDR3 sequence
GWKIIPTDR

SEQ ID NO: 1522 - protein, 9 aa, Artificial
  CDR3 sequence
GWKIIPTDR

SEQ ID NO: 1523 - protein, 9 aa, Artificial
  CDR3 sequence
GWKIIPTDR

SEQ ID NO: 1524 - protein, 9 aa, Artificial
  CDR3 sequence
GWKVWPTDR

SEQ ID NO: 1525 - protein, 9 aa, Artificial
  CDR3 sequence
GWKVWPTDR

SEQ ID NO: 1526 - protein, 9 aa, Artificial
  CDR3 sequence
GWKILPAER

SEQ ID NO: 1527 - protein, 9 aa, Artificial
  CDR3 sequence
GWKILPAER

SEQ ID NO: 1528 - protein, 9 aa, Artificial
  CDR3 sequence
GWKILPAER

SEQ ID NO: 1529 - protein, 9 aa, Artificial
  CDR3 sequence
GWKIHPADR

SEQ ID NO: 1530 - protein, 9 aa, Artificial
  CDR3 sequence
GWKILPAER

SEQ ID NO: 1531 - protein, 9 aa, Artificial
  CDR3 sequence
GWKIRPTIP

SEQ ID NO: 1532 - protein, 11 aa, Artificial
  CDR3 sequence
GWQSTTKNQGY

SEQ ID NO: 1533 - protein, 11 aa, Artificial
  CDR3 sequence
GWQSTTKNQGY

SEQ ID NO: 1534 - protein, 11 aa, Artificial
  CDR3 sequence
GWQSTTKSQGY

SEQ ID NO: 1535 - protein, 11 aa, Artificial
  CDR3 sequence
GWQSTTKNQNY

SEQ ID NO: 1536 - protein, 15 aa, Artificial
  CDR3 sequence
NWRDAGTTWFEKSGS

SEQ ID NO: 1537 - protein, 15 aa, Artificial
  CDR3 sequence
NWRDAGTTWFEKSGS

SEQ ID NO: 1538 - protein, 15 aa, Artificial
  CDR3 sequence
NWRDAGTTWFEKSGS

SEQ ID NO: 1539 - protein, 15 aa, Artificial
  CDR3 sequence
NWRDAGTTWFEKSGS

SEQ ID NO: 1540 - protein, 15 aa, Artificial
  CDR3 sequence
NWRDAGTTWFEKSGS

SEQ ID NO: 1541 - protein, 15 aa, Artificial
  CDR3 sequence
NWRDAGTTWFEKSGS

SEQ ID NO: 1542 - protein, 15 aa, Artificial
  CDR3 sequence
NWRDAGTTWFEKSGS

SEQ ID NO: 1543 - protein, 15 aa, Artificial
  CDR3 sequence
NWGDAGTTWFEKSGS

SEQ ID NO: 1544 - protein, 15 aa, Artificial
  CDR3 sequence
NWGDAGTTWFEKSGS

SEQ ID NO: 1545 - protein, 15 aa, Artificial
  CDR3 sequence
NWGDAGTTWFEKSGS

SEQ ID NO: 1546 - protein, 15 aa, Artificial
  CDR3 sequence
NWGDAGTTWFEKSGS

SEQ ID NO: 1547 - protein, 15 aa, Artificial
  CDR3 sequence
NWGDAGTTWFEKSGS

SEQ ID NO: 1548 - protein, 15 aa, Artificial
  CDR3 sequence
NWGDAGTTWFEKSGS

SEQ ID NO: 1549 - protein, 15 aa, Artificial
  CDR3 sequence
NWGDAGTTWFEKSGS

SEQ ID NO: 1550 - protein, 15 aa, Artificial
  CDR3 sequence
NWGDAGTTWFEKSGS

SEQ ID NO: 1551 - protein, 15 aa, Artificial
  CDR3 sequence
NWGDAGTTWFEKSGS

SEQ ID NO: 1552 - protein, 15 aa, Artificial
  CDR3 sequence
NWGDAGTTWFEKSGS

SEQ ID NO: 1553 - protein, 15 aa, Artificial
  CDR3 sequence
NWGDAGTTWFEKSGS

SEQ ID NO: 1554 - protein, 15 aa, Artificial
  CDR3 sequence
NWGDAGTTWFEKSGS

SEQ ID NO: 1555 - protein, 15 aa, Artificial
  CDR3 sequence
NWGDAGTTWFEKSGS

SEQ ID NO: 1556 - protein, 15 aa, Artificial
  CDR3 sequence
NWGDAGTTWFEKSGS

SEQ ID NO: 1557 - protein, 15 aa, Artificial
  CDR3 sequence
NWGDAGTTWFEKSGS

SEQ ID NO: 1558 - protein, 15 aa, Artificial
  CDR3 sequence
NWGDAGTTWFEKSGS

SEQ ID NO: 1559 - protein, 15 aa, Artificial
  CDR3 sequence
NWGDAGTTWFEKSGS

SEQ ID NO: 1560 - protein, 15 aa, Artificial
  CDR3 sequence
NWGDAGTTWFEKSGS

SEQ ID NO: 1561 - protein, 15 aa, Artificial
  CDR3 sequence
NWRDAGTTWFEKSGS

SEQ ID NO: 1562 - protein, 10 aa, Artificial
  CDR3 sequence
FRTAAQGTDY

SEQ ID NO: 1563 - protein, 18 aa, Artificial
  CDR3 sequence
HKTPYTTLELNRPHAFGS

SEQ ID NO: 1564 - protein, 11 aa, Artificial
  CDR3 sequence
DQRLDGSTLAY

SEQ ID NO: 1565 - protein, 15 aa, Artificial
  CDR3 sequence
ETYGSGSSLMTEYDY

SEQ ID NO: 1566 - protein, 15 aa, Artificial
  CDR3 sequence
ETYGSGSSLMSEYDY

SEQ ID NO: 1567 - protein, 15 aa, Artificial
  CDR3 sequence
ETYGSGSSLMSEYDY

SEQ ID NO: 1568 - protein, 15 aa, Artificial
  CDR3 sequence
ETYGSGSSLMSEYDY

SEQ ID NO: 1569 - protein, 15 aa, Artificial
  CDR3 sequence
ETFGSGSSLMSEYDY

SEQ ID NO: 1570 - protein, 15 aa, Artificial
  CDR3 sequence
DTYGSGSSLMNEYDY

SEQ ID NO: 1571 - protein, 15 aa, Artificial
  CDR3 sequence
ETYGSGSSLMNEYDY

SEQ ID NO: 1572 - protein, 15 aa, Artificial
  CDR3 sequence
ETYGSGSSLMNEYDY

SEQ ID NO: 1573 - protein, 15 aa, Artificial
  CDR3 sequence
ETYGSGSSLMNEYDY

SEQ ID NO: 1574 - protein, 15 aa, Artificial
  CDR3 sequence
EPYGSGSSLISEYDY

SEQ ID NO: 1575 - protein, 15 aa, Artificial
  CDR3 sequence
EPYGSGSSLISEYDY

SEQ ID NO: 1576 - protein, 15 aa, Artificial
  CDR3 sequence
EPYGSGSSLMSEYDY

SEQ ID NO: 1577 - protein, 12 aa, Artificial
  CDR3 sequence
NWKMLLGVENDY

SEQ ID NO: 1578 - protein, 14 aa, Artificial
  CDR3 sequence
KIGWLSIRGDEYEY

SEQ ID NO: 1579 - protein, 19 aa, Artificial
  CDR3 sequence
LPFVCPSGSYSDYGDEYDY

SEQ ID NO: 1580 - protein, 12 aa, Artificial
  CDR3 sequence
HVSDSDYTEYDY

SEQ ID NO: 1581 - protein, 16 aa, Artificial
  CDR3 sequence
RRSSLYTSSNVFEYDY

SEQ ID NO: 1582 - protein, 5 aa, Artificial
  CDR3 sequence
VNADY

SEQ ID NO: 1583 - protein, 5 aa, Artificial
  CDR3 sequence
VNADY

SEQ ID NO: 1584 - protein, 5 aa, Artificial
  CDR3 sequence
VNADY

SEQ ID NO: 1585 - protein, 5 aa, Artificial
  CDR3 sequence
VNADY

SEQ ID NO: 1586 - protein, 5 aa, Artificial
  CDR3 sequence
VNADY

SEQ ID NO: 1587 - protein, 5 aa, Artificial
  CDR3 sequence
VNGDI

SEQ ID NO: 1588 - protein, 5 aa, Artificial
  CDR3 sequence
VNGDI

SEQ ID NO: 1589 - protein, 5 aa, Artificial
  CDR3 sequence
VNADI

SEQ ID NO: 1590 - protein, 5 aa, Artificial
  CDR3 sequence
VNGDY

SEQ ID NO: 1591 - protein, 5 aa, Artificial
  CDR3 sequence
VNGDY

SEQ ID NO: 1592 - protein, 5 aa, Artificial
  CDR3 sequence
VNGDY

SEQ ID NO: 1593 - protein, 5 aa, Artificial
  CDR3 sequence
VNGDY

SEQ ID NO: 1594 - protein, 5 aa, Artificial
  CDR3 sequence
VNGDY

SEQ ID NO: 1595 - protein, 12 aa, Artificial
  CDR3 sequence
VWKLPRFVDNDY

SEQ ID NO: 1596 - protein, 12 aa, Artificial
  CDR3 sequence
NWKMLLGVENDY

SEQ ID NO: 1597 - protein, 12 aa, Artificial
  CDR3 sequence
NWKMLLGVENDY

SEQ ID NO: 1598 - protein, 5 aa, Artificial
  CDR3 sequence
VNRDY

SEQ ID NO: 1599 - protein, 5 aa, Artificial
  CDR3 sequence
VNRDY

SEQ ID NO: 1600 - protein, 5 aa, Artificial
  CDR3 sequence
VNRDY

SEQ ID NO: 1601 - protein, 5 aa, Artificial
  CDR3 sequence
VNRDY

SEQ ID NO: 1602 - protein, 5 aa, Artificial
  CDR3 sequence
VNRDY

SEQ ID NO: 1603 - protein, 5 aa, Artificial
  CDR3 sequence
VNRDY

SEQ ID NO: 1604 - protein, 5 aa, Artificial
  CDR3 sequence
VNRDY

SEQ ID NO: 1605 - protein, 5 aa, Artificial
  CDR3 sequence
VNRDY

SEQ ID NO: 1606 - protein, 5 aa, Artificial
  CDR3 sequence
VNRDY

SEQ ID NO: 1607 - protein, 5 aa, Artificial
  CDR3 sequence
VNRDY

SEQ ID NO: 1608 - protein, 5 aa, Artificial
  CDR3 sequence
VNRDY

SEQ ID NO: 1609 - protein, 5 aa, Artificial
  CDR3 sequence
VNRDY

SEQ ID NO: 1610 - protein, 5 aa, Artificial
  CDR3 sequence
VNRDY

SEQ ID NO: 1611 - protein, 5 aa, Artificial
  CDR3 sequence
VNREY

SEQ ID NO: 1612 - protein, 5 aa, Artificial
  CDR3 sequence
VNREY

SEQ ID NO: 1613 - protein, 5 aa, Artificial
  CDR3 sequence
VNREY

SEQ ID NO: 1614 - protein, 14 aa, Artificial
  CDR3 sequence
KPGWVARDPSQYNY

SEQ ID NO: 1615 - protein, 14 aa, Artificial
  CDR3 sequence
KPGWVARDPSEYNY

SEQ ID NO: 1616 - protein, 5 aa, Artificial
  CDR3 sequence
FNRDL

SEQ ID NO: 1617 - protein, 5 aa, Artificial
  CDR3 sequence
VNRDL

SEQ ID NO: 1618 - protein, 13 aa, Artificial
  CDR3 sequence
DANPNCGLNVWNS

SEQ ID NO: 1619 - protein, 8 aa, Artificial
  CDR3 sequence
RDYYYMPF

SEQ ID NO: 1620 - protein, 5 aa, Artificial
  CDR3 sequence
INEDQ

SEQ ID NO: 1621 - protein, 5 aa, Artificial
  CDR3 sequence
INEDQ

SEQ ID NO: 1622 - protein, 5 aa, Artificial
  CDR3 sequence
INEDQ

SEQ ID NO: 1623 - protein, 5 aa, Artificial
  CDR3 sequence
INEDQ

SEQ ID NO: 1624 - protein, 5 aa, Artificial
  CDR3 sequence
INADQ

SEQ ID NO: 1625 - protein, 5 aa, Artificial
  CDR3 sequence
INRDI

SEQ ID NO: 1626 - protein, 5 aa, Artificial
  CDR3 sequence
INHDI

SEQ ID NO: 1627 - protein, 5 aa, Artificial
  CDR3 sequence
INRDY

SEQ ID NO: 1628 - protein, 5 aa, Artificial
  CDR3 sequence
INRDY

SEQ ID NO: 1629 - protein, 5 aa, Artificial
  CDR3 sequence
INRDY

SEQ ID NO: 1630 - protein, 5 aa, Artificial
  CDR3 sequence
INGDY

SEQ ID NO: 1631 - protein, 5 aa, Artificial
  CDR3 sequence
INGDY

SEQ ID NO: 1632 - protein, 5 aa, Artificial
  CDR3 sequence
TNGDY

SEQ ID NO: 1633 - protein, 12 aa, Artificial
  CDR3 sequence
DISTFGWGPFDY

SEQ ID NO: 1634 - protein, 9 aa, Artificial
  CDR3 sequence
RWDIVGAIW

SEQ ID NO: 1635 - protein, 9 aa, Artificial
  CDR3 sequence
RWDIVGAIW

SEQ ID NO: 1636 - protein, 9 aa, Artificial
  CDR3 sequence
RWLEIGAEY

SEQ ID NO: 1637 - protein, 9 aa, Artificial
  CDR3 sequence
SWSYPGLTY

SEQ ID NO: 1638 - protein, 9 aa, Artificial
  CDR3 sequence
VWRAIGRTY

SEQ ID NO: 1639 - protein, 10 aa, Artificial
  CDR3 sequence
DRRSYNGRQY

SEQ ID NO: 1640 - protein, 14 aa, Artificial
  CDR3 sequence
GGREYSGVYYYREY

SEQ ID NO: 1641 - protein, 13 aa, Artificial
  CDR3 sequence
RPSDTTWSESSAS

SEQ ID NO: 1642 - protein, 12 aa, Artificial
  CDR3 sequence
DLGNSGRGPYTN

SEQ ID NO: 1643 - protein, 13 aa, Artificial
  CDR3 sequence
DCGVPGFGWTFSS

SEQ ID NO: 1644 - protein, 9 aa, Artificial
  CDR3 sequence
KQLPYLQNF

SEQ ID NO: 1645 - protein, 9 aa, Artificial
  CDR3 sequence
KQLPYLQNF

SEQ ID NO: 1646 - protein, 7 aa, Artificial
  CDR3 sequence
HRWGLNY

SEQ ID NO: 1647 - protein, 12 aa, Artificial
  CDR3 sequence
ARSSSSYYDFGS

SEQ ID NO: 1648 - protein, 12 aa, Artificial
  CDR3 sequence
ARSSSSYYDFGS

SEQ ID NO: 1649 - protein, 13 aa, Artificial
  CDR3 sequence
DRGSGTCYADFGS

SEQ ID NO: 1650 - protein, 11 aa, Artificial
  CDR3 sequence
GWGPAVTSIPV

SEQ ID NO: 1651 - protein, 5 aa, Artificial
  CDR3 sequence
INRDI

SEQ ID NO: 1652 - protein, 5 aa, Artificial
  CDR3 sequence
INRDI

SEQ ID NO: 1653 - protein, 5 aa, Artificial
  CDR3 sequence
INRDI

SEQ ID NO: 1654 - protein, 5 aa, Artificial
  CDR3 sequence
INRDI

SEQ ID NO: 1655 - protein, 15 aa, Artificial
  CDR3 sequence
SRDYSRSRDPTSYDR

SEQ ID NO: 1656 - protein, 13 aa, Artificial
  CDR3 sequence
PRGSSLYLLEYDY

SEQ ID NO: 1657 - protein, 13 aa, Artificial
  CDR3 sequence
DFYLATLAHEYDY

SEQ ID NO: 1658 - protein, 13 aa, Artificial
  CDR3 sequence
DFYVSTLAHEYDY

SEQ ID NO: 1659 - protein, 13 aa, Artificial
  CDR3 sequence
DFYVSTLAHEYDY

SEQ ID NO: 1660 - protein, 13 aa, Artificial
  CDR3 sequence
DFYVSTLAHEYDY

SEQ ID NO: 1661 - protein, 14 aa, Artificial
  CDR3 sequence
DTFTLSTLSHEYDY

SEQ ID NO: 1662 - protein, 13 aa, Artificial
  CDR3 sequence
DLIVATLPGEYDY

SEQ ID NO: 1663 - protein, 13 aa, Artificial
  CDR3 sequence
DEILATLPHEYDY

SEQ ID NO: 1664 - protein, 15 aa, Artificial
  CDR3 sequence
DAYTVIATLPHEYDY

SEQ ID NO: 1665 - protein, 14 aa, Artificial
  CDR3 sequence
KHSTVAGLTHEYDY

SEQ ID NO: 1666 - protein, 12 aa, Artificial
  CDR3 sequence
VYVSTWGNGYDY

SEQ ID NO: 1667 - protein, 17 aa, Artificial
  CDR3 sequence
RRSGYYSLSTSPHQYAY

SEQ ID NO: 1668 - protein, 16 aa, Artificial
  CDR3 sequence
RVNYAAYSRLEHDYHY

SEQ ID NO: 1669 - protein, 16 aa, Artificial
  CDR3 sequence
RVNYAAYSRLEHDYHY

SEQ ID NO: 1670 - protein, 8 aa, Artificial
  CDR3 sequence
NRAGIYEY

SEQ ID NO: 1671 - protein, 14 aa, Artificial
  CDR3 sequence
RLFMATPNQGQYYY

SEQ ID NO: 1672 - protein, 14 aa, Artificial
  CDR3 sequence
RPSYSTNNVKSYRY

SEQ ID NO: 1673 - protein, 14 aa, Artificial
  CDR3 sequence
RPAVVHTRKESYPY

SEQ ID NO: 1674 - protein, 16 aa, Artificial
  CDR3 sequence
RINYSVLTTTSSSYHY

SEQ ID NO: 1675 - protein, 16 aa, Artificial
  CDR3 sequence
DFRSTWLSSSGSSYTY

SEQ ID NO: 1676 - protein, 13 aa, Artificial
  CDR3 sequence
RRIVNVEGAYRDY

SEQ ID NO: 1677 - protein, 13 aa, Artificial
  CDR3 sequence
KVVVAVEGAKYDY

SEQ ID NO: 1678 - protein, 15 aa, Artificial
  CDR3 sequence
CRISWCAGAESDYGY

SEQ ID NO: 1679 - protein, 18 aa, Artificial
  CDR3 sequence
DSITDRRSVAVAHTSYYY

SEQ ID NO: 1680 - protein, 14 aa, Artificial
  CDR3 sequence
RLSSVAVASTRYDY

SEQ ID NO: 1681 - protein, 16 aa, Artificial
  CDR3 sequence
NRQSGVASENLRLYTY

SEQ ID NO: 1682 - protein, 14 aa, Artificial
  CDR3 sequence
DKQSGVSVNPKYAY

SEQ ID NO: 1683 - protein, 10 aa, Artificial
  CDR3 sequence
QTLGRSLYDY

SEQ ID NO: 1684 - protein, 17 aa, Artificial
  CDR3 sequence
SRYSGGVATARRSEYHY

SEQ ID NO: 1685 - protein, 16 aa, Artificial
  CDR3 sequence
VATYSRNVGSVRNYDY

SEQ ID NO: 1686 - protein, 17 aa, Artificial
  CDR3 sequence
SQPLNYYTYYDARRYDY

SEQ ID NO: 1687 - protein, 16 aa, Artificial
  CDR3 sequence
TPVYYQRYYDQNAYDY

SEQ ID NO: 1688 - protein, 10 aa, Artificial
  CDR3 sequence
KYYSYYAYDY

SEQ ID NO: 1689 - protein, 16 aa, Artificial
  CDR3 sequence
SPVYYIDYSSQYKYGY

SEQ ID NO: 1690 - protein, 16 aa, Artificial
  CDR3 sequence
QIYYRTNYYSQNAYDY

SEQ ID NO: 1691 - protein, 16 aa, Artificial
  CDR3 sequence
QIYYRTNYYSQNNYDY

SEQ ID NO: 1692 - protein, 16 aa, Artificial
  CDR3 sequence
QIYYRTNYYSQNVYDY

SEQ ID NO: 1693 - protein, 16 aa, Artificial
  CDR3 sequence
QIYYRTNYYSQNEYDY

SEQ ID NO: 1694 - protein, 16 aa, Artificial
  CDR3 sequence
QIYYRTNYSSQSNYDY

SEQ ID NO: 1695 - protein, 16 aa, Artificial
  CDR3 sequence
ATAYRTNYSSRDKYDY

SEQ ID NO: 1696 - protein, 13 aa, Artificial
  CDR3 sequence
YLSFYSDYEVYDY

SEQ ID NO: 1697 - protein, 11 aa, Artificial
  CDR3 sequence
DPTYGSGRWTY

SEQ ID NO: 1698 - protein, 19 aa, Artificial
  CDR3 sequence
SVTYYSGSHAYTQEGGYAR

SEQ ID NO: 1699 - protein, 17 aa, Artificial
  CDR3 sequence
RQPYASGSHYSSTQYTY

SEQ ID NO: 1700 - protein, 10 aa, Artificial
  CDR3 sequence
LYRGRSVYDD

SEQ ID NO: 1701 - protein, 18 aa, Artificial
  CDR3 sequence
SSYGSTYYSQGRAYYYDY

SEQ ID NO: 1702 - protein, 15 aa, Artificial
  CDR3 sequence
SPYGPLYRSTHYYDY

SEQ ID NO: 1703 - protein, 18 aa, Artificial
  CDR3 sequence
TTYYSGSYISTLSTSYNY

SEQ ID NO: 1704 - protein, 3 aa, Artificial
  CDR3 sequence
GSY

SEQ ID NO: 1705 - protein, 3 aa, Artificial
  CDR3 sequence
GSY

SEQ ID NO: 1706 - protein, 18 aa, Artificial
  CDR3 sequence
RDSSTLDSTYYVGGSYNY

SEQ ID NO: 1707 - protein, 3 aa, Artificial
  CDR3 sequence
GSY

SEQ ID NO: 1708 - protein, 16 aa, Artificial
  CDR3 sequence
RMYGSDWLPRPEDFDS

SEQ ID NO: 1709 - protein, 12 aa, Artificial
  CDR3 sequence
DVSPSYGSRWYG

SEQ ID NO: 1710 - protein, 18 aa, Artificial
  CDR3 sequence
RREYSTIYTARYPGEYVY

SEQ ID NO: 1711 - protein, 8 aa, Artificial
  CDR3 sequence
RERGIYDS

SEQ ID NO: 1712 - protein, 16 aa, Artificial
  CDR3 sequence
DDYLGGDNWYLGPYDS

SEQ ID NO: 1713 - protein, 15 aa, Artificial
  CDR3 sequence
RKTYRSLTYYGEYDS

SEQ ID NO: 1714 - protein, 17 aa, Artificial
  CDR3 sequence
DRLLYYSSGYYQTSVDV

SEQ ID NO: 1715 - protein, 17 aa, Artificial
  CDR3 sequence
DRFLYYSAGRYDTGSDI

SEQ ID NO: 1716 - protein, 17 aa, Artificial
  CDR3 sequence
DRVLYYSDSRYYTGSNY

SEQ ID NO: 1717 - protein, 19 aa, Artificial
  CDR3 sequence
DRALYRNYSDGRYYTGYDY

SEQ ID NO: 1718 - protein, 7 aa, Artificial
  CDR3 sequence
RILSRNY

SEQ ID NO: 1719 - protein, 18 aa, Artificial
  CDR3 sequence
SRRFYSGLYYYTDDAYEY

SEQ ID NO: 1720 - protein, 18 aa, Artificial
  CDR3 sequence
SRRFYSGLVYYSVDAYEN

SEQ ID NO: 1721 - protein, 18 aa, Artificial
  CDR3 sequence
TKRYYSIKYYSTVEDYEY

SEQ ID NO: 1722 - protein, 19 aa, Artificial
  CDR3 sequence
NRYYCSTYGCLSTPRQYDY

SEQ ID NO: 1723 - protein, 12 aa, Artificial
  CDR3 sequence
RVYTGTYGGRNY

SEQ ID NO: 1724 - protein, 9 aa, Artificial
  CDR3 sequence
GYSLPAFDS

SEQ ID NO: 1725 - protein, 9 aa, Artificial
  CDR3 sequence
GIDLYTFHY

SEQ ID NO: 1726 - protein, 9 aa, Artificial
  CDR3 sequence
GIDLYTFDY

SEQ ID NO: 1727 - protein, 17 aa, Artificial
  CDR3 sequence
NSDSGFDSYSVWAAYEY

SEQ ID NO: 1728 - protein, 10 aa, Artificial
  CDR3 sequence
LLTVWDTYKY

SEQ ID NO: 1729 - protein, 17 aa, Artificial
  CDR3 sequence
TNRWYTGVYDLPSRYEY

SEQ ID NO: 1730 - protein, 17 aa, Artificial
  CDR3 sequence
TNRWFSAVYDLPSRYTY

SEQ ID NO: 1731 - protein, 6 aa, Artificial
  CDR3 sequence
DLPSRL

SEQ ID NO: 1732 - protein, 17 aa, Artificial
  CDR3 sequence
TSRWYSAVYDLPTRYDY

SEQ ID NO: 1733 - protein, 16 aa, Artificial
  CDR3 sequence
DRSYSIDYRHPDSYSY

SEQ ID NO: 1734 - protein, 15 aa, Artificial
  CDR3 sequence
DPLLFYGVGSADVDY

SEQ ID NO: 1735 - protein, 9 aa, Artificial
  CDR3 sequence
ISGLVQRDY

SEQ ID NO: 1736 - protein, 15 aa, Artificial
  CDR3 sequence
GGHLLGYDVQWEPDY

SEQ ID NO: 1737 - protein, 16 aa, Artificial
  CDR3 sequence
HKRTYELGAHSTDFGS

SEQ ID NO: 1738 - protein, 17 aa, Artificial
  CDR3 sequence
AVFVDSGDFSVCRGVGY

SEQ ID NO: 1739 - protein, 12 aa, Artificial
  CDR3 sequence
LRSWPRGVDSGS

SEQ ID NO: 1740 - protein, 14 aa, Artificial
  CDR3 sequence
DVIYKNIGSGSFDY

SEQ ID NO: 1741 - protein, 14 aa, Artificial
  CDR3 sequence
DVIYKNIGSGSFDY

SEQ ID NO: 1742 - protein, 14 aa, Artificial
  CDR3 sequence
SKWYGGFGDTDIEY

SEQ ID NO: 1743 - protein, 14 aa, Artificial
  CDR3 sequence
SKWYGGFGDTDIEY

SEQ ID NO: 1744 - protein, 6 aa, Artificial
  CDR3 sequence
DGPFGN

SEQ ID NO: 1745 - protein, 16 aa, Artificial
  CDR3 sequence
SRHSGNTLSFSLKYDY

SEQ ID NO: 1746 - protein, 16 aa, Artificial
  CDR3 sequence
RRWSGTLSLFDNEYYY

SEQ ID NO: 1747 - protein, 12 aa, Artificial
  CDR3 sequence
DNYRDSYLEYDY

SEQ ID NO: 1748 - protein, 16 aa, Artificial
  CDR3 sequence
SWDHGDYVDGGFFYDY

SEQ ID NO: 1749 - protein, 15 aa, Artificial
  CDR3 sequence
AGSAGPPSIDRQYDY

SEQ ID NO: 1750 - protein, 10 aa, Artificial
  CDR3 sequence
DVRDSIWRSY

SEQ ID NO: 1751 - protein, 11 aa, Artificial
  CDR3 sequence
GWGATQAQSGF

SEQ ID NO: 1752 - protein, 11 aa, Artificial
  CDR3 sequence
GWGATQAQHGF

SEQ ID NO: 1753 - protein, 12 aa, Artificial
  CDR3 sequence
SSSLATISQPSS

SEQ ID NO: 1754 - protein, 10 aa, Artificial
  CDR3 sequence
KAVTSRDHEY

SEQ ID NO: 1755 - protein, 19 aa, Artificial
  CDR3 sequence
NSDEFYSGTLKLQSRMVEY

SEQ ID NO: 1756 - protein, 9 aa, Artificial
  CDR3 sequence
GWKTDEYVK

SEQ ID NO: 1757 - protein, 11 aa, Artificial
  CDR3 sequence
GWVTPSYEYGN

SEQ ID NO: 1758 - protein, 19 aa, Artificial
  CDR3 sequence
DQKYGMSYSRLWLVSEYEY

SEQ ID NO: 1759 - protein, 7 aa, Artificial
  CDR3 sequence
GWGDSAY

SEQ ID NO: 1760 - protein, 15 aa, Artificial
  CDR3 sequence
NGIESYGWGNRHFNY

SEQ ID NO: 1761 - protein, 10 aa, Artificial
  CDR3 sequence
GGWGTGRYNY

SEQ ID NO: 1762 - protein, 12 aa, Artificial
  CDR3 sequence
GWGTAPLSTSVY

SEQ ID NO: 1763 - protein, 15 aa, Artificial
  CDR3 sequence
DRFNTIANLPGEYDY

SEQ ID NO: 1764 - protein, 15 aa, Artificial
  CDR3 sequence
ETFNSISNLPGEYDY

SEQ ID NO: 1765 - protein, 15 aa, Artificial
  CDR3 sequence
DHFTFMSNLPSEYDY

SEQ ID NO: 1766 - protein, 15 aa, Artificial
  CDR3 sequence
RKIYRSLSYYGDYDS

SEQ ID NO: 1767 - protein, 14 aa, Artificial
  CDR3 sequence
RLTMATPNQSQYYY

SEQ ID NO: 1768 - protein, 7 aa, Artificial
  CDR3 sequence
SGIGTDN

SEQ ID NO: 1769 - protein, 7 aa, Artificial
  CDR3 sequence
SGIGTDN

SEQ ID NO: 1770 - protein, 14 aa, Artificial
  CDR3 sequence
DILYKTDIYYRNDF

SEQ ID NO: 1771 - protein, 22 aa, Artificial
  CDR3 sequence
LPYTICPVVVKKGAVYYGVDDY

SEQ ID NO: 1772 - protein, 11 aa, Artificial
  CDR3 sequence
GFSDRSFAVTH

SEQ ID NO: 1773 - protein, 15 aa, Artificial
  CDR3 sequence
DFRLARLRVADDYDY

SEQ ID NO: 1774 - protein, 20 aa, Artificial
  CDR3 sequence
LRTDYSINWANCQRDSLYGY

SEQ ID NO: 1775 - protein, 11 aa, Artificial
  CDR3 sequence
GGWTRTHPFDY

SEQ ID NO: 1776 - protein, 11 aa, Artificial
  FR4 sequence
RGHGTQVTVSS

SEQ ID NO: 1777 - protein, 11 aa, Artificial
  FR4 sequence
MGHGTQVTVSS

SEQ ID NO: 1778 - protein, 11 aa, Artificial
  FR4 sequence
GGHGTQVTVSS

SEQ ID NO: 1779 - protein, 11 aa, Artificial
  FR4 sequence
GGHGTQVTVSS

SEQ ID NO: 1780 - protein, 11 aa, Artificial
  FR4 sequence
GGHGTQVTVSS

SEQ ID NO: 1781 - protein, 11 aa, Artificial
  FR4 sequence
RGHGTQVTVSS

SEQ ID NO: 1782 - protein, 11 aa, Artificial
  FR4 sequence
TGHGTQVTVSS

SEQ ID NO: 1783 - protein, 11 aa, Artificial
  FR4 sequence
TGHGTQVTVSS

SEQ ID NO: 1784 - protein, 11 aa, Artificial
  FR4 sequence
GGHGTQVTVSS

SEQ ID NO: 1785 - protein, 11 aa, Artificial
  FR4 sequence
GSHGTQVTVSS

SEQ ID NO: 1786 - protein, 11 aa, Artificial
  FR4 sequence
RGHGTQVTVSS

SEQ ID NO: 1787 - protein, 11 aa, Artificial
  FR4 sequence
RGHGTQVTVSS

SEQ ID NO: 1788 - protein, 11 aa, Artificial
  FR4 sequence
RGHGTQVTVSS

SEQ ID NO: 1789 - protein, 11 aa, Artificial
  FR4 sequence
GSHGTQVTVSS

SEQ ID NO: 1790 - protein, 11 aa, Artificial
  FR4 sequence
GSHGTQVTVSS

SEQ ID NO: 1791 - protein, 11 aa, Artificial
  FR4 sequence
GSHGTQVTVSS

SEQ ID NO: 1792 - protein, 11 aa, Artificial
  FR4 sequence
RGHGTQVTVSS

SEQ ID NO: 1793 - protein, 11 aa, Artificial
  FR4 sequence
RGHGTQVTVSS

SEQ ID NO: 1794 - protein, 11 aa, Artificial
  FR4 sequence
RGHGTQVTVSS

SEQ ID NO: 1795 - protein, 11 aa, Artificial
  FR4 sequence
RGHGTQVTVSS

SEQ ID NO: 1796 - protein, 11 aa, Artificial
  FR4 sequence
RGHGTQVTVSS

SEQ ID NO: 1797 - protein, 11 aa, Artificial
  FR4 sequence
RGHGTQVTVSS

SEQ ID NO: 1798 - protein, 11 aa, Artificial
  FR4 sequence
RGHGTQVTVSS

SEQ ID NO: 1799 - protein, 11 aa, Artificial
  FR4 sequence
GTHGTQVTVSS

SEQ ID NO: 1800 - protein, 11 aa, Artificial
  FR4 sequence
GTHGTQVTVSS

SEQ ID NO: 1801 - protein, 11 aa, Artificial
  FR4 sequence
RGHGTQVTVSS

SEQ ID NO: 1802 - protein, 11 aa, Artificial
  FR4 sequence
RGHGTPVTVSS

SEQ ID NO: 1803 - protein, 11 aa, Artificial
  FR4 sequence
RGHGTQVTVSS

SEQ ID NO: 1804 - protein, 11 aa, Artificial
  FR4 sequence
GGHGTQVTVSS

SEQ ID NO: 1805 - protein, 11 aa, Artificial
  FR4 sequence
RGHGTQVTVSS

SEQ ID NO: 1806 - protein, 11 aa, Artificial
  FR4 sequence
MGHGTQVTVSS

SEQ ID NO: 1807 - protein, 11 aa, Artificial
  FR4 sequence
WGQGTQVTVSS

SEQ ID NO: 1808 - protein, 11 aa, Artificial
  FR4 sequence
WGQGTQVTVSS

SEQ ID NO: 1809 - protein, 11 aa, Artificial
  FR4 sequence
WGQGTQVTVSS

SEQ ID NO: 1810 - protein, 11 aa, Artificial
  FR4 sequence
WGQGTQVTVSS

SEQ ID NO: 1811 - protein, 11 aa, Artificial
  FR4 sequence
AGQGTQVTVSS

SEQ ID NO: 1812 - protein, 11 aa, Artificial
  FR4 sequence
AGQGTQVTVSS

SEQ ID NO: 1813 - protein, 11 aa, Artificial
  FR4 sequence
AGQGTQVTVSS

SEQ ID NO: 1814 - protein, 11 aa, Artificial
  FR4 sequence
AGQGTQVTVSS

SEQ ID NO: 1815 - protein, 11 aa, Artificial
  FR4 sequence
AGQGTQVTVSS

SEQ ID NO: 1816 - protein, 11 aa, Artificial
  FR4 sequence
AGQGTQVTVSS

SEQ ID NO: 1817 - protein, 11 aa, Artificial
  FR4 sequence
AGQGTQVTVSS

SEQ ID NO: 1818 - protein, 11 aa, Artificial
  FR4 sequence
AGPGTQVTVSS

SEQ ID NO: 1819 - protein, 11 aa, Artificial
  FR4 sequence
AGQGTQVTVSS

SEQ ID NO: 1820 - protein, 11 aa, Artificial
  FR4 sequence
AGQGTQVTVSS

SEQ ID NO: 1821 - protein, 11 aa, Artificial
  FR4 sequence
AGQGTQVTVSS

SEQ ID NO: 1822 - protein, 11 aa, Artificial
  FR4 sequence
AGPGTQVTVSS

SEQ ID NO: 1823 - protein, 11 aa, Artificial
  FR4 sequence
AGQGTQVTVSS

SEQ ID NO: 1824 - protein, 11 aa, Artificial
  FR4 sequence
AGQGTQVTVSS

SEQ ID NO: 1825 - protein, 11 aa, Artificial
  FR4 sequence
AGQGTQVTVSS

SEQ ID NO: 1826 - protein, 11 aa, Artificial
  FR4 sequence
AGQGTQVTVSS

SEQ ID NO: 1827 - protein, 11 aa, Artificial
  FR4 sequence
AGPGTQVTVSS

SEQ ID NO: 1828 - protein, 11 aa, Artificial
  FR4 sequence
AGQGTQVTVSS

SEQ ID NO: 1829 - protein, 11 aa, Artificial
  FR4 sequence
AGQGTQVTVSS

SEQ ID NO: 1830 - protein, 11 aa, Artificial
  FR4 sequence
AGQGTQVTVSS

SEQ ID NO: 1831 - protein, 11 aa, Artificial
  FR4 sequence
AGQGTQVTVSS

SEQ ID NO: 1832 - protein, 11 aa, Artificial
  FR4 sequence
AGQGTQVTVSS

SEQ ID NO: 1833 - protein, 11 aa, Artificial
  FR4 sequence
AGQGTQVTVSS

SEQ ID NO: 1834 - protein, 11 aa, Artificial
  FR4 sequence
AGQGTQVTVSS

SEQ ID NO: 1835 - protein, 11 aa, Artificial
  FR4 sequence
AGPGTQVTVSS

SEQ ID NO: 1836 - protein, 11 aa, Artificial
  FR4 sequence
AGQGTQVTVSS

SEQ ID NO: 1837 - protein, 11 aa, Artificial
  FR4 sequence
WGQGTQVTVSS

SEQ ID NO: 1838 - protein, 11 aa, Artificial
  FR4 sequence
WGQGTQVTVSS

SEQ ID NO: 1839 - protein, 11 aa, Artificial
  FR4 sequence
WGQGTQVTVSS

SEQ ID NO: 1840 - protein, 11 aa, Artificial
  FR4 sequence
WGQGTQVTVSS

SEQ ID NO: 1841 - protein, 11 aa, Artificial
  FR4 sequence
WGQGTQVTVSS

SEQ ID NO: 1842 - protein, 11 aa, Artificial
  FR4 sequence
WGQGTQVTVSS

SEQ ID NO: 1843 - protein, 11 aa, Artificial
  FR4 sequence
WGQGTQVTVSS

SEQ ID NO: 1844 - protein, 11 aa, Artificial
  FR4 sequence
WGQGTQVTVSS

SEQ ID NO: 1845 - protein, 11 aa, Artificial
  FR4 sequence
WGQGTQVTVSS

SEQ ID NO: 1846 - protein, 11 aa, Artificial
  FR4 sequence
WGQGTQVTVSS

SEQ ID NO: 1847 - protein, 11 aa, Artificial
  FR4 sequence
WGQGTQVTVSS

SEQ ID NO: 1848 - protein, 11 aa, Artificial
  FR4 sequence
WGQGTQVTVSS

SEQ ID NO: 1849 - protein, 11 aa, Artificial
  FR4 sequence
WGHGTQVTVSS

SEQ ID NO: 1850 - protein, 11 aa, Artificial
  FR4 sequence
WGHGTQVTVSS

SEQ ID NO: 1851 - protein, 11 aa, Artificial
  FR4 sequence
WGHGTQVTVSS

SEQ ID NO: 1852 - protein, 11 aa, Artificial
  FR4 sequence
WGQGTQVTVSS

SEQ ID NO: 1853 - protein, 11 aa, Artificial
  FR4 sequence
WGQGTQVTVSS

SEQ ID NO: 1854 - protein, 11 aa, Artificial
  FR4 sequence
WGQGTQVTVSS

SEQ ID NO: 1855 - protein, 11 aa, Artificial
  FR4 sequence
WGQGTQVTVSS

SEQ ID NO: 1856 - protein, 11 aa, Artificial
  FR4 sequence
WGQGTQVTVSS

SEQ ID NO: 1857 - protein, 11 aa, Artificial
  FR4 sequence
WGQGTQVTVSS

SEQ ID NO: 1858 - protein, 11 aa, Artificial
  FR4 sequence
WGQGTQVTVSS

SEQ ID NO: 1859 - protein, 11 aa, Artificial
  FR4 sequence
WGQGTPVTVSS

SEQ ID NO: 1860 - protein, 11 aa, Artificial
  FR4 sequence
WGQGTQVTVSS

SEQ ID NO: 1861 - protein, 11 aa, Artificial
  FR4 sequence
WGQGTQVTVSS

SEQ ID NO: 1862 - protein, 11 aa, Artificial
  FR4 sequence
WGQGTQVTVSS

SEQ ID NO: 1863 - protein, 11 aa, Artificial
  FR4 sequence
WGQGTPVTVSS

SEQ ID NO: 1864 - protein, 11 aa, Artificial
  FR4 sequence
WGQGTQVTVSS

SEQ ID NO: 1865 - protein, 11 aa, Artificial
  FR4 sequence
WGQGTQVTVSS

SEQ ID NO: 1866 - protein, 11 aa, Artificial
  FR4 sequence
WGQGTQVTVSS

SEQ ID NO: 1867 - protein, 11 aa, Artificial
  FR4 sequence
WGQGTQVTVSS

SEQ ID NO: 1868 - protein, 11 aa, Artificial
  FR4 sequence
WGQGTQVTVSS

SEQ ID NO: 1869 - protein, 11 aa, Artificial
  FR4 sequence
WGQGTQVTVSS

SEQ ID NO: 1870 - protein, 11 aa, Artificial
  FR4 sequence
WGQGTQVTVSS

SEQ ID NO: 1871 - protein, 11 aa, Artificial
  FR4 sequence
WGQGTQVTVSS

SEQ ID NO: 1872 - protein, 11 aa, Artificial
  FR4 sequence
WGQGTQVTVSS

SEQ ID NO: 1873 - protein, 11 aa, Artificial
  FR4 sequence
WGQGTQVTVSS

SEQ ID NO: 1874 - protein, 11 aa, Artificial
  FR4 sequence
WGQGTQVTVSS

SEQ ID NO: 1875 - protein, 11 aa, Artificial
  FR4 sequence
WGQGTQVTVSS

SEQ ID NO: 1876 - protein, 11 aa, Artificial
  FR4 sequence
WGQGTQVTVSS

SEQ ID NO: 1877 - protein, 11 aa, Artificial
  FR4 sequence
WGQGTQVTVSS

SEQ ID NO: 1878 - protein, 11 aa, Artificial
  FR4 sequence
WGQGTQVTVSS

SEQ ID NO: 1879 - protein, 11 aa, Artificial
  FR4 sequence
WGQGTQVTVSS

SEQ ID NO: 1880 - protein, 11 aa, Artificial
  FR4 sequence
WGQGTQVTVSS

SEQ ID NO: 1881 - protein, 11 aa, Artificial
  FR4 sequence
WGQGTQVTVSS

SEQ ID NO: 1882 - protein, 11 aa, Artificial
  FR4 sequence
WGQGTQVTVSS

SEQ ID NO: 1883 - protein, 11 aa, Artificial
  FR4 sequence
WGQGTQVTVSS

SEQ ID NO: 1884 - protein, 11 aa, Artificial
  FR4 sequence
WGQGTQVTVSS

SEQ ID NO: 1885 - protein, 11 aa, Artificial
  FR4 sequence
WGQGTQVTVSS

SEQ ID NO: 1886 - protein, 11 aa, Artificial
  FR4 sequence
WGQGTQVTVSS

SEQ ID NO: 1887 - protein, 11 aa, Artificial
  FR4 sequence
WGQGTQVTVSS

SEQ ID NO: 1888 - protein, 11 aa, Artificial
  FR4 sequence
WGQGTQVTVSS

SEQ ID NO: 1889 - protein, 11 aa, Artificial
  FR4 sequence
WGQGTQVTVSS

SEQ ID NO: 1890 - protein, 11 aa, Artificial
  FR4 sequence
WGQGTQVTVSS

SEQ ID NO: 1891 - protein, 11 aa, Artificial
  FR4 sequence
WGQGTQVTVSS

SEQ ID NO: 1892 - protein, 11 aa, Artificial
  FR4 sequence
WGQGTQVTVSS

SEQ ID NO: 1893 - protein, 11 aa, Artificial
  FR4 sequence
WGQGTQVTVSS

SEQ ID NO: 1894 - protein, 11 aa, Artificial
  FR4 sequence
WGQGTQVTVSS

SEQ ID NO: 1895 - protein, 11 aa, Artificial
  FR4 sequence
WGQGTQVTVSS

SEQ ID NO: 1896 - protein, 11 aa, Artificial
  FR4 sequence
WGQGTQVTVSS

SEQ ID NO: 1897 - protein, 11 aa, Artificial
  FR4 sequence
WGQGTQVTVSS

SEQ ID NO: 1898 - protein, 11 aa, Artificial
  FR4 sequence
WGQGTQVTVSS

SEQ ID NO: 1899 - protein, 11 aa, Artificial
  FR4 sequence
WGQGTQVTVSS

SEQ ID NO: 1900 - protein, 11 aa, Artificial
  FR4 sequence
WGQGSQVTVSS

SEQ ID NO: 1901 - protein, 11 aa, Artificial
  FR4 sequence
WGRGSQVTVSS

SEQ ID NO: 1902 - protein, 11 aa, Artificial
  FR4 sequence
WGQGTQVTVSS

SEQ ID NO: 1903 - protein, 11 aa, Artificial
  FR4 sequence
WGQGTQVTVSS

SEQ ID NO: 1904 - protein, 11 aa, Artificial
  FR4 sequence
WGQGTQVTVSS

SEQ ID NO: 1905 - protein, 11 aa, Artificial
  FR4 sequence
WGQGTQVTVSS

SEQ ID NO: 1906 - protein, 11 aa, Artificial
  FR4 sequence
WGQGTQVTVSS

SEQ ID NO: 1907 - protein, 11 aa, Artificial
  FR4 sequence
WGQGTQVTVSS

SEQ ID NO: 1908 - protein, 11 aa, Artificial
  FR4 sequence
WGQGTQVTVSS

SEQ ID NO: 1909 - protein, 11 aa, Artificial
  FR4 sequence
WGQGTQVTVSS

SEQ ID NO: 1910 - protein, 11 aa, Artificial
  FR4 sequence
WGQGTQVTVSS

SEQ ID NO: 1911 - protein, 11 aa, Artificial
  FR4 sequence
WGQGTQVTVSS

SEQ ID NO: 1912 - protein, 11 aa, Artificial
  FR4 sequence
WGKGTLVTVSS

SEQ ID NO: 1913 - protein, 11 aa, Artificial
  FR4 sequence
WGQGTQVTVSS

SEQ ID NO: 1914 - protein, 11 aa, Artificial
  FR4 sequence
WGQGTQVTVSS

SEQ ID NO: 1915 - protein, 11 aa, Artificial
  FR4 sequence
WGQGTQVTVSS

SEQ ID NO: 1916 - protein, 11 aa, Artificial
  FR4 sequence
WGQGTQVTVSS

SEQ ID NO: 1917 - protein, 11 aa, Artificial
  FR4 sequence
WGQGTQVTVSS

SEQ ID NO: 1918 - protein, 11 aa, Artificial
  FR4 sequence
WGQGTQVTVSS

SEQ ID NO: 1919 - protein, 11 aa, Artificial
  FR4 sequence
WGQGTQVTVSS

SEQ ID NO: 1920 - protein, 11 aa, Artificial
  FR4 sequence
WGQGTQVTVSS

SEQ ID NO: 1921 - protein, 11 aa, Artificial
  FR4 sequence
WGQGTQVTVSS

SEQ ID NO: 1922 - protein, 11 aa, Artificial
  FR4 sequence
WGQGTQVTVSS

SEQ ID NO: 1923 - protein, 11 aa, Artificial
  FR4 sequence
WGQGTQVTVSS

SEQ ID NO: 1924 - protein, 11 aa, Artificial
  FR4 sequence
WGQGTQVTVSS

SEQ ID NO: 1925 - protein, 11 aa, Artificial
  FR4 sequence
ATLGTQVTVSS

SEQ ID NO: 1926 - protein, 11 aa, Artificial
  FR4 sequence
WGQGSQVTVSS

SEQ ID NO: 1927 - protein, 11 aa, Artificial
  FR4 sequence
WGQGSQVTVSS

SEQ ID NO: 1928 - protein, 11 aa, Artificial
  FR4 sequence
WGQGSQVTVSS

SEQ ID NO: 1929 - protein, 11 aa, Artificial
  FR4 sequence
WGQGSQVTVSS

SEQ ID NO: 1930 - protein, 11 aa, Artificial
  FR4 sequence
WGQGTQVTVSS

SEQ ID NO: 1931 - protein, 11 aa, Artificial
  FR4 sequence
WGQGTQVTVSS

SEQ ID NO: 1932 - protein, 11 aa, Artificial
  FR4 sequence
WGQGTQVTVSS

SEQ ID NO: 1933 - protein, 11 aa, Artificial
  FR4 sequence
WGQGTQVTVSS

SEQ ID NO: 1934 - protein, 11 aa, Artificial
  FR4 sequence
WGQGTQVTVSS

SEQ ID NO: 1935 - protein, 11 aa, Artificial
  FR4 sequence
WGQGTQVTVSS

SEQ ID NO: 1936 - protein, 11 aa, Artificial
  FR4 sequence
WGQGTQVTVSS

SEQ ID NO: 1937 - protein, 11 aa, Artificial
  FR4 sequence
WGQGTQVTVSS

SEQ ID NO: 1938 - protein, 11 aa, Artificial
  FR4 sequence
WGQGTQVTVSS

SEQ ID NO: 1939 - protein, 11 aa, Artificial
  FR4 sequence
WGQGTQVTVSS

SEQ ID NO: 1940 - protein, 11 aa, Artificial
  FR4 sequence
WGQGTQVTVSS

SEQ ID NO: 1941 - protein, 11 aa, Artificial
  FR4 sequence
WGQGTQVTVSS

SEQ ID NO: 1942 - protein, 11 aa, Artificial
  FR4 sequence
WGQGTQVTVSS

SEQ ID NO: 1943 - protein, 11 aa, Artificial
  FR4 sequence
WGQGTQVTVSS

SEQ ID NO: 1944 - protein, 11 aa, Artificial
  FR4 sequence
WGQGTQVTVSS

SEQ ID NO: 1945 - protein, 11 aa, Artificial
  FR4 sequence
WGQGTQVTVSS

SEQ ID NO: 1946 - protein, 11 aa, Artificial
  FR4 sequence
WGQGTQVTVSS

SEQ ID NO: 1947 - protein, 11 aa, Artificial
  FR4 sequence
WGQGTQVTVSS

SEQ ID NO: 1948 - protein, 11 aa, Artificial
  FR4 sequence
WGQGTQVTVSS

SEQ ID NO: 1949 - protein, 11 aa, Artificial
  FR4 sequence
WGQGTQVTVSS

SEQ ID NO: 1950 - protein, 11 aa, Artificial
  FR4 sequence
WGQGTQVTVSS

SEQ ID NO: 1951 - protein, 11 aa, Artificial
  FR4 sequence
WGQGTQVTVSS

SEQ ID NO: 1952 - protein, 11 aa, Artificial
  FR4 sequence
WGQGTQVTVSS

SEQ ID NO: 1953 - protein, 11 aa, Artificial
  FR4 sequence
WGQGTQVTVSS

SEQ ID NO: 1954 - protein, 11 aa, Artificial
  FR4 sequence
WGQGTQVTVSS

SEQ ID NO: 1955 - protein, 11 aa, Artificial
  FR4 sequence
WGQGTQVTVSS

SEQ ID NO: 1956 - protein, 11 aa, Artificial
  FR4 sequence
WGQGTQVTVSS

SEQ ID NO: 1957 - protein, 11 aa, Artificial
  FR4 sequence
WGQGTQVTVSS

SEQ ID NO: 1958 - protein, 11 aa, Artificial
  FR4 sequence
WGQGTQVTVSS

SEQ ID NO: 1959 - protein, 11 aa, Artificial
  FR4 sequence
WGQGTQVTVSS

SEQ ID NO: 1960 - protein, 11 aa, Artificial
  FR4 sequence
WGQGTQVTVSS

SEQ ID NO: 1961 - protein, 11 aa, Artificial
  FR4 sequence
WGQGTQVTVSS

SEQ ID NO: 1962 - protein, 11 aa, Artificial
  FR4 sequence
WGQGTQVTVSS

SEQ ID NO: 1963 - protein, 11 aa, Artificial
  FR4 sequence
WGQGTQVTVSS

SEQ ID NO: 1964 - protein, 11 aa, Artificial
  FR4 sequence
WGQGTQVTVSS

SEQ ID NO: 1965 - protein, 11 aa, Artificial
  FR4 sequence
WGQGTQVTVSS

SEQ ID NO: 1966 - protein, 11 aa, Artificial
  FR4 sequence
WGQGTQVTVSS

SEQ ID NO: 1967 - protein, 11 aa, Artificial
  FR4 sequence
WGQGTQVTVSS

SEQ ID NO: 1968 - protein, 11 aa, Artificial
  FR4 sequence
WGQGTQVTVSS

SEQ ID NO: 1969 - protein, 11 aa, Artificial
  FR4 sequence
WGQGTQVTVSS

SEQ ID NO: 1970 - protein, 11 aa, Artificial
  FR4 sequence
WGQGTQVTVSS

SEQ ID NO: 1971 - protein, 11 aa, Artificial
  FR4 sequence
WGQGTQVTVSS

SEQ ID NO: 1972 - protein, 11 aa, Artificial
  FR4 sequence
WGQGTQVTVSS

SEQ ID NO: 1973 - protein, 11 aa, Artificial
  FR4 sequence
WGQGTQVTVSS

SEQ ID NO: 1974 - protein, 11 aa, Artificial
  FR4 sequence
WGQGTQVTVSS

SEQ ID NO: 1975 - protein, 11 aa, Artificial
  FR4 sequence
WGQGTQVTVSS

SEQ ID NO: 1976 - protein, 11 aa, Artificial
  FR4 sequence
WGQGTQVTVSS

SEQ ID NO: 1977 - protein, 11 aa, Artificial
  FR4 sequence
WGQGTQVTVSS

SEQ ID NO: 1978 - protein, 11 aa, Artificial
  FR4 sequence
WGQGTQVTVSS

SEQ ID NO: 1979 - protein, 11 aa, Artificial
  FR4 sequence
RGQGTQVTVSS

SEQ ID NO: 1980 - protein, 11 aa, Artificial
  FR4 sequence
RGQGTQVTVSS

SEQ ID NO: 1981 - protein, 11 aa, Artificial
  FR4 sequence
WGRGTQVTVSS

SEQ ID NO: 1982 - protein, 11 aa, Artificial
  FR4 sequence
RGQGTQVTVSS

SEQ ID NO: 1983 - protein, 11 aa, Artificial
  FR4 sequence
WGQGTQVTVSS

SEQ ID NO: 1984 - protein, 11 aa, Artificial
  FR4 sequence
WGQGTQVTVSS

SEQ ID NO: 1985 - protein, 11 aa, Artificial
  FR4 sequence
WGQGTQVTVSS

SEQ ID NO: 1986 - protein, 11 aa, Artificial
  FR4 sequence
WGQGTQVTVSS

SEQ ID NO: 1987 - protein, 11 aa, Artificial
  FR4 sequence
WGQGTQVTVSS

SEQ ID NO: 1988 - protein, 11 aa, Artificial
  FR4 sequence
WGQGTQVTVSS

SEQ ID NO: 1989 - protein, 11 aa, Artificial
  FR4 sequence
WGQGTQVTVSS

SEQ ID NO: 1990 - protein, 11 aa, Artificial
  FR4 sequence
WGQGTQVTVSS

SEQ ID NO: 1991 - protein, 11 aa, Artificial
  FR4 sequence
WGQGTQVTVSS

SEQ ID NO: 1992 - protein, 11 aa, Artificial
  FR4 sequence
WGQGTQVTVSS

SEQ ID NO: 1993 - protein, 11 aa, Artificial
  FR4 sequence
WGQGNQVTVSS

SEQ ID NO: 1994 - protein, 11 aa, Artificial
  FR4 sequence
WGQGTQVTVSS

SEQ ID NO: 1995 - protein, 11 aa, Artificial
  FR4 sequence
WGQGTQVTVSS

SEQ ID NO: 1996 - protein, 11 aa, Artificial
  FR4 sequence
WGQGTQVTVSS

SEQ ID NO: 1997 - protein, 11 aa, Artificial
  FR4 sequence
WGQGTQVTVSS

SEQ ID NO: 1998 - protein, 11 aa, Artificial
  FR4 sequence
WGQGTQVTVSS

SEQ ID NO: 1999 - protein, 11 aa, Artificial
  FR4 sequence
WGPGTQVTVSS

SEQ ID NO: 2000 - protein, 11 aa, Artificial
  FR4 sequence
FGQGTQVTVSS

SEQ ID NO: 2001 - protein, 11 aa, Artificial
  FR4 sequence
FGQGTQVTVSS

SEQ ID NO: 2002 - protein, 11 aa, Artificial
  FR4 sequence
WGQGTQVTVSS

SEQ ID NO: 2003 - protein, 11 aa, Artificial
  FR4 sequence
WGQGTQVTVSS

SEQ ID NO: 2004 - protein, 11 aa, Artificial
  FR4 sequence
WGQGTQVTVSS

SEQ ID NO: 2005 - protein, 11 aa, Artificial
  FR4 sequence
WGQGTQVTVSS

SEQ ID NO: 2006 - protein, 11 aa, Artificial
  FR4 sequence
WGQGTQVTVSS

SEQ ID NO: 2007 - protein, 11 aa, Artificial
  FR4 sequence
WGQGTQVTVSS

SEQ ID NO: 2008 - protein, 11 aa, Artificial
  FR4 sequence
WGQGTQVTVSS

SEQ ID NO: 2009 - protein, 11 aa, Artificial
  FR4 sequence
WGQGTQVTVSS

SEQ ID NO: 2010 - protein, 11 aa, Artificial
  FR4 sequence
WGQGTQVTVSS

SEQ ID NO: 2011 - protein, 11 aa, Artificial
  FR4 sequence
WGQGTQVTVSS

SEQ ID NO: 2012 - protein, 11 aa, Artificial
  FR4 sequence
WGQGTQVTVSS

SEQ ID NO: 2013 - protein, 11 aa, Artificial
  FR4 sequence
WGKGTQVTVSS

SEQ ID NO: 2014 - protein, 11 aa, Artificial
  FR4 sequence
WGQGTQVTVSS

SEQ ID NO: 2015 - protein, 11 aa, Artificial
  FR4 sequence
WGQGTQVTVSS

SEQ ID NO: 2016 - protein, 11 aa, Artificial
  FR4 sequence
WGQGTQVTVSS

SEQ ID NO: 2017 - protein, 11 aa, Artificial
  FR4 sequence
WGQGTQVTVSS

SEQ ID NO: 2018 - protein, 11 aa, Artificial
  FR4 sequence
WGQGTQVTVSS

SEQ ID NO: 2019 - protein, 11 aa, Artificial
  FR4 sequence
WGQGTQVTVSS

SEQ ID NO: 2020 - protein, 11 aa, Artificial
  FR4 sequence
WGQGTQVTVSS

SEQ ID NO: 2021 - protein, 11 aa, Artificial
  FR4 sequence
WGQGTQVTVSS

SEQ ID NO: 2022 - protein, 11 aa, Artificial
  FR4 sequence
WGQGTQVTVSS

SEQ ID NO: 2023 - protein, 11 aa, Artificial
  FR4 sequence
WGQGTQVTVSS

SEQ ID NO: 2024 - protein, 11 aa, Artificial
  FR4 sequence
WGQGTQVTVSS

SEQ ID NO: 2025 - protein, 11 aa, Artificial
  FR4 sequence
WGQGTQVTVSS

SEQ ID NO: 2026 - protein, 11 aa, Artificial
  FR4 sequence
WGQGTQVTVSS

SEQ ID NO: 2027 - protein, 11 aa, Artificial
  FR4 sequence
WGQGTQVTVSS

SEQ ID NO: 2028 - protein, 11 aa, Artificial
  FR4 sequence
WGQGTQVTVSS

SEQ ID NO: 2029 - protein, 11 aa, Artificial
  FR4 sequence
WGQGTQVTVSS

SEQ ID NO: 2030 - protein, 11 aa, Artificial
  FR4 sequence
WGQGTQVTVSS

SEQ ID NO: 2031 - protein, 11 aa, Artificial
  FR4 sequence
WGQGTQVTVSS

SEQ ID NO: 2032 - protein, 11 aa, Artificial
  FR4 sequence
WGQGTQVTVSS

SEQ ID NO: 2033 - protein, 11 aa, Artificial
  FR4 sequence
WGQGTQVTVSS

SEQ ID NO: 2034 - protein, 11 aa, Artificial
  FR4 sequence
WGQGTQVTVSS

SEQ ID NO: 2035 - protein, 11 aa, Artificial
  FR4 sequence
WTVGTQVTVSS

SEQ ID NO: 2036 - protein, 11 aa, Artificial
  FR4 sequence
WGQGTQVTVSS

SEQ ID NO: 2037 - protein, 11 aa, Artificial
  FR4 sequence
WGQGTQVTVSS

SEQ ID NO: 2038 - protein, 11 aa, Artificial
  FR4 sequence
WGQGTQVTVSS

SEQ ID NO: 2039 - protein, 11 aa, Artificial
  FR4 sequence
WGQGTQVTVSS

SEQ ID NO: 2040 - protein, 11 aa, Artificial
  FR4 sequence
WGQGTQVTVSS

SEQ ID NO: 2041 - protein, 11 aa, Artificial
  FR4 sequence
WGQGTQVTVSS

SEQ ID NO: 2042 - protein, 11 aa, Artificial
  FR4 sequence
WGQGTQVTVSS

SEQ ID NO: 2043 - protein, 11 aa, Artificial
  FR4 sequence
WGQGIEVTVSS

SEQ ID NO: 2044 - protein, 11 aa, Artificial
  FR4 sequence
WGQGIEVTVSS

SEQ ID NO: 2045 - protein, 11 aa, Artificial
  FR4 sequence
WGQGTQVTVSS

SEQ ID NO: 2046 - protein, 11 aa, Artificial
  FR4 sequence
WGKGTQVTVSS

SEQ ID NO: 2047 - protein, 11 aa, Artificial
  FR4 sequence
KGQGTQVTVSS

SEQ ID NO: 2048 - protein, 11 aa, Artificial
  FR4 sequence
WGQGTQVTVSS

SEQ ID NO: 2049 - protein, 11 aa, Artificial
  FR4 sequence
WGQGTQVTVSS

SEQ ID NO: 2050 - protein, 11 aa, Artificial
  FR4 sequence
WGQGTQVTVSS

SEQ ID NO: 2051 - protein, 118 aa, Artificial
  Nanobody sequence
EVQLVESGGGLVHPGGSLRLSCVGSGFSLDDYGMTWVRRAPGKGLEWVSSINWSGTHTDYADSVKGRFTISRDNAKNTLFLQMNSLNPEDTAVYYCGQGWKIVPTNPRGHGTQVTVSS

SEQ ID NO: 2052 - protein, 118 aa, Artificial
  Nanobody sequence
EVQLVESGGGLVQPGGSLRLSCVGSGFSLDDYAMTWVRQAPGKGLEWVSSINWSGTHTDYADSVKGRFTISRDNAKNTLFLQMNSLSPEDTAVYYCNQGWKIRPTIPMGHGTQVTVSS

SEQ ID NO: 2053 - protein, 118 aa, Artificial
  Nanobody sequence
EVQLVESGGGLVQPGGSLRLSCVASGFSLDDYGMTWVRQAPGKGLEWVSSINWSGTHTDYTDPVKGRFTISRDNAKNTLFLQMNNLTPEDTAVYYCNRGWKIVPTDLGGHGTQVTVSS

SEQ ID NO: 2054 - protein, 118 aa, Artificial
  Nanobody sequence
EVQLVESGGGLVQPGGSLRLSCVASGFSLDDYGMTWVRQAPGKGLEWVSSINWSGTHTDYADSVKGRFTISRDNAKNTLFLQMNNLRSEDTAVYSCNQGWKIVPTDRGGHGTQVTVSS

SEQ ID NO: 2055 - protein, 118 aa, Artificial
  Nanobody sequence
EVQLVESGGGLVQPGGSLRLSCVASGFSLDDYGMTWVRQAPGKGLEWVSSINWSGTHTDYADSVKGRFTISRDNAKNTLFLQMNSLRSEDTAVYYCNQGWKIVPTDRGGHGTQVTVSS

SEQ ID NO: 2056 - protein, 118 aa, Artificial
  Nanobody sequence
EVQLVESGGGLVQPGGSLRLSCVASGFSLDDYGMTWVRQAPGKGLEWVSSINWSGTHTDYADSVKGRFTISRDNAKNTLFLQMNSLRSEDTAVYYCNQGWKIVPTDRRGHGTQVTVSS

SEQ ID NO: 2057 - protein, 118 aa, Artificial
  Nanobody sequence
EVQLVESGGGLVQPGGSLRLSCVASGFSLDDYGMTWVRQAPGKGLEWVSSINWSGTHTDYADSVKGRFTISRDNAKNTLFLQMNSLRSEDTAVYYCNQGWKIVPTDRTGHGTQVTVSS

SEQ ID NO: 2058 - protein, 117 aa, Artificial
  Nanobody sequence
EVQLVESGGGLVQAGGSLRLSCVASKMTFMRYTMGWYRQAPGKQRDLVASIDSSGGTNYADSVKGRFTISRDNAKNTVYLEMNSLTPEDTAVYYCNQGWKIVPTDRTGHGTQVTVSS

SEQ ID NO: 2059 - protein, 118 aa, Artificial
  Nanobody sequence
EVQLMESGGGLVQPGGSLRLSCVASGFSLDDYGMTWVRQAPGKGLEWVSSINWSGTHTDYADSVKGRFTISRDNAKNTLFLQMNSLRSEDTAVYYCNQGWKIVPTDRGGHGTQVTVSS

SEQ ID NO: 2060 - protein, 118 aa, Artificial
  Nanobody sequence
EVQLVESGGGLVQPGGSLRLSCVASGFSLDDYGMTWVRQAPGKGLEWVSSINWSGTHTDYADSVKGRFTISRDNAKNTLFLQMNSLRSEDTAVYYCNQGWKIVPTDRGSHGTQVTVSS

SEQ ID NO: 2061 - protein, 118 aa, Artificial
  Nanobody sequence
EVQLVESGGGLVQPGGSLRLSCVASGFSLDDYGMTWVRQAPGKELEWISSINWSGTHTDYADSVKGRFTISRDNAKNTLFLQMNSLTPEDTAVYYCNQGWKIVPMDRRGHGTQVTVSS

SEQ ID NO: 2062 - protein, 118 aa, Artificial
  Nanobody sequence
EVQLVESGGGLVQPGGSLRLSCVASGFSLDDYGMTWVRQAPGKGLEWVSSINWSGTHTDYADSVKGRFTISRDNAKNTLFLQMNSLTPEDTAVYYCNQGWKIIPTDRRGHGTQVTVSS

SEQ ID NO: 2063 - protein, 118 aa, Artificial
  Nanobody sequence
EVQLVESGGGLVQPGGSLRLSCVASGFSLDDYAMTWVRQAPGKGLEWVSSINWSGTHTDYADSVKGRFTISRDNARNTLFLQMNSLTPEDTAIYYCNQGWKILPTDRRGHGTQVTVSS

SEQ ID NO: 2064 - protein, 118 aa, Artificial
  Nanobody sequence
EVQLVESGGGLVQPGGSLRLSCVASGFSLDDYGMTWVRQAPGKGLEWVSSINWSGTHTDYADSVKGRFTISRDNAKNTLFLQMNSLSPEDTAVYYCNQGWKILPTNRGSHGTQVTVSS

SEQ ID NO: 2065 - protein, 118 aa, Artificial
  Nanobody sequence
EVQLVESGGGLVQPGGSLRLSCVASGFSLDDYGMTWVRQAPGKGFEWVSSINWSGTHTDYADSVKGRFTISRDNAKNTLFLQMNSLSPEDTAVYYCNQGWKILPTNRGSHGTQVTVSS

SEQ ID NO: 2066 - protein, 118 aa, Artificial
  Nanobody sequence
EVQLVESGGGLVQPGGSLRLSCVASGFSLDDYGMTWVRQAPGKGLEWVSSINWSGTHTDYADSVKGRFTISRDNAKNTLFLQMNSLSPEDTAVYYCNRGWKILPTNRGSHGTQVTVSS

SEQ ID NO: 2067 - protein, 118 aa, Artificial; identical to SEQ ID NO: 2062
  Nanobody sequence

SEQ ID NO: 2068 - protein, 118 aa, Artificial
  Nanobody sequence
EVQLVESGGGLVQPGGSLRLSCVASGFSLDDYGMTWVRQAPGKGLEWVSSINWSGTHTDYADSVRGRFVISRDNAKNTLFLQMNSLSPEDTAVYYCNQGWKIIPTDRRGHGTQVTVSS

SEQ ID NO: 2069 - protein, 118 aa, Artificial
  Nanobody sequence
EVQLVESGGGLVQPGGSLRLSCVASGFSLDDYGMTWVRQAPGKGLEWVSSINWSGTHTDYTDSVKGRFTISRDNAKNTLFLQMNSLTPEDTAVYYCNQGWKIIPTDRRGHGTQVTVSS

SEQ ID NO: 2070 - protein, 118 aa, Artificial
  Nanobody sequence
EVQLVESGGGLVQPGGSLKLSCVASGFSLDDYGMTWVRQAPGKGLEWVSSINWNVTHTDYAYSVKGRFTISRDNAKNTLFLQMNSLTPEDTAVYYCNQGWKIIPTDRRGHGTQVTVSS

SEQ ID NO: 2071 - protein, 118 aa, Artificial
  Nanobody sequence
EVQLVESGGGLVQPGGSLRLSCVASGFSLDDYGMTWVRQAPGKGLEWVSSINWSGTHTDCADSVKGRFTISRDNAKNTLFLQMNSLTPEDTAVYYCNQGWKIIPTDRRGHGTQVTVSS

SEQ ID NO: 2072 - protein, 118 aa, Artificial
  Nanobody sequence
EVQLVESGGGLVQPGGSLRLSCVASGFSLDDYGMTWVRQAPGKGLEWVSSINWSGTHTDYADSVKGRFTISRDNAKNTLFLQMNNLTPEDTAVYYCNQGWKIIPTDRRGHGTQVTVSS

SEQ ID NO: 2073 - protein, 118 aa, Artificial
  Nanobody sequence
EVQLVESGGGLVQPGGSLRLSCVASGFSLDDYGMTWVRQAPGKGLEWVSSINWSGTHTDYADSVKGRFVISRDNAKNTLFLQMNSLSPEDTAVYYCNQGWKIIPTDRRGHGTQVTVSS

SEQ ID NO: 2074 - protein, 118 aa, Artificial
  Nanobody sequence
EVQLVESGGGLVQPGGSLRLSCVASGFSLDDYAMTWVRQAPGKGLEWVSSINWSGTHTDYADSVKGRFTISRDNAKNTLFLQMNSLSPEDTAVYYCNKGWKVWPTDRGTHGTQVTVSS

SEQ ID NO: 2075 - protein, 118 aa, Artificial
  Nanobody sequence
EVQLVESGGGLVQPGGSLRLSCVASGFSLDDYAMTWVRQAPGKGLEWVSSINWSGTHTDYADSVKGRFTISRDNAKNTLFLQMNSLNPEDTAVYYCNQGWKVWPTDRGTHGTQVTVSS

SEQ ID NO: 2076 - protein, 118 aa, Artificial
  Nanobody sequence
EVQLVESGGGLVQPGGSLRLSCVASGFSLDDYGMTWVRQAPGKGLEWVSSINWSGTHTDYADSVKGRFTISRDNAKNTLFLQMNSLTPEDTAVYYCNQGWKILPAERRGHGTQVTVSS

SEQ ID NO: 2077 - protein, 118 aa, Artificial
  Nanobody sequence
EVQLVESGGGLVQPGGSLRLSCVASGFSLDDYGMTWVRQAPGKGLEWVSSINWSGTHTDYADSVKGRFTISRDNAKNTLFLQMNSLTPEDTAVYYCNQGWKILPAERRGHGTPVTVSS

SEQ ID NO: 2078 - protein, 118 aa, Artificial
  Nanobody sequence
EVQLVESGGGLVQPGGSLKLSCVASGFSLDDYGMTWVRQAPGKGLEWVSSINWNGTHTDYAYSVKGRFTISRDNAKNTLFLQMNSLTPENTAVYYCNQGWKILPAERRGHGTQVTVSS

SEQ ID NO: 2079 - protein, 118 aa, Artificial
  Nanobody sequence
EVQLVESGGGLVQPGGSLRLSCVASGFSLINYAMTWVRQAPGKGLEWVSSINWSGTHTDYADSVKGRFTISRDNAKNTLFLHMNNLSPEDTAVYYCGQGWKIHPADRGGHGTQVTVSS

SEQ ID NO: 2080 - protein, 118 aa, Artificial; identical to SEQ ID NO: 2076
  Nanobody sequence

SEQ ID NO: 2081 - protein, 118 aa, Artificial; identical to SEQ ID NO: 2052
  Nanobody sequence

SEQ ID NO: 2082 - protein, 120 aa, Artificial
  Nanobody sequence
EVQLVESGGGLVQPGGSLRLSCAASGFIFDDYAMSWVRQAPGKGLEWVSAINWSGSHRNYADSVKGRFTISRDNAKKTVYLQMNSLQSEDTAVYYCGTGWQSTTKNQGYWGQGTQVTVSS

SEQ ID NO: 2083 - protein, 120 aa, Artificial
  Nanobody sequence
EVQLVESGGGLVQPGGSLRLSCAASGFIFDDYAMSWVRQAPGKGLEWVSAINWSGTHRNYADSVKGRFTISRDNNKKTVYLQMNSLKSEDTAVYYCATGWQSTTKNQGYWGQGTQVTVSS

SEQ ID NO: 2084 - protein, 120 aa, Artificial
  Nanobody sequence
EVQLVESGGGLVQPGGSLKLSCAASGFIFDDYAMSWVRQAPGKGLEWVSAINWSGSHRNYADSVKGRFTISRDNAKKTVYLQMNSLQSEDTAVYYCGTGWQSTTKSQGYWGQGTQVTVSS

SEQ ID NO: 2085 - protein, 120 aa, Artificial
  Nanobody sequence
EVQLVESGGGLVQPGGSLTLSCAGSGFIFDDYAMSWVRQAPGKGLEWVSSINWSGSHRNYADSVKGRFTISRDNAKKTLYLQMNSLKSEDTAVYYCATGWQSTTKNQNYWGQGTQVTVSS

SEQ ID NO: 2086 - protein, 124 aa, Artificial
  Nanobody sequence
EVQLVESGGSLVQPGGSLRLSCAASGFTFDDYAMSWVRQAPGKGLEWISSINWSGTHKDYADSVKGRFTISRNNANNTLYLQMNNLKFEDTAVYYCAKNWRDAGTTWFEKSGSAGQGTQVTVSS

SEQ ID NO: 2087 - protein, 124 aa, Artificial
  Nanobody sequence
EVQLVESGGSLVQPGESLRLSCAASGFTFDDYAMSWVRQAPGKGLEWISSINWSGTHTDYADSVKGRFTISRNNANNTLYLQMNNLKFEDTAVYYCAKNWRDAGTTWFEKSGSAGQGTQVTVSS

SEQ ID NO: 2088 - protein, 124 aa, Artificial
  Nanobody sequence
EVQLVESGGSLVPPGGSLRLSCAASGFTFDDYAMSWVRQAPGKGLEWVSSINWSGTHTDYTDSVKGRFTISRNNANNTLYLQMNSLKSEDTAVYYCAKNWRDAGTTWFEKSGSAGQGTQVTVSS

SEQ ID NO: 2089 - protein, 124 aa, Artificial
  Nanobody sequence
EVQLVESGGSLVQPGGSLRLSCAASGFTFDDYAMSWVRQAPGKGLEWISSINWSGTHTDYADSVKGRFTISRNNANNTLYLQMNNLKFEDTAVYYCAKNWRDAGTTWFEKSGSAGQGTQVTVSS

SEQ ID NO: 2090 - protein, 124 aa, Artificial
  Nanobody sequence
EVQLVESGGSLVQPGGSLRLSCAASGFTFDDYAMSWVRQVPGKGLEWVSSINWSGTHTDYADSVKGRFTISRNNANNTLYLQMNSLKSEDTAVYYCAKNWRDAGTTWFEKSGSAGQGTQVTVSS

SEQ ID NO: 2091 - protein, 124 aa, Artificial
  Nanobody sequence
EVQLVESGGSLVPPGGSLRLSCAVSGFTFDDYAMSWVRQAPGKGLEWVSSINWSGTHTDYTDSVKGRFTISRNNANNMLYLQMNSLKSEDTAVYYCAKNWRDAGTTWFEKSGSAGQGTQVTVSS

SEQ ID NO: 2092 - protein, 124 aa, Artificial
  Nanobody sequence
EVQLVESGGSLVQPGGSLRLSCAASGFTFDDYALSWVRQAPGKGLEWISSINWSGTHTDYADSVKGRFTISRNNANNTLYLQMNNLKFEDTAVYYCAKNWRDAGTTWFEKSGSAGQGTQVTVSS

SEQ ID NO: 2093 - protein, 124 aa, Artificial
  Nanobody sequence
EVQLVESGGSLVQPGGSLRLSCAASGFTFDDYAMTWVRQAPGKGLEWVSSINWSGTHTDYADSVKGRFTISRNNANNTLYLQMNSLKSDDTAVYYCAKNWGDAGTTWFEKSGSAGPGTQVTVSS

SEQ ID NO: 2094 - protein, 124 aa, Artificial
  Nanobody sequence
EVQLVESGGSLVQPGGSLRLSCAASGFTFDDYAMTWVRQASGKGLEWVSSINWSGTHTDYTDSVKGRFTISRNNANNTLYLQMNSLKSEDTAVYYCAKNWGDAGTTWFEKSGSAGQGTQVTVSS

SEQ ID NO: 2095 - protein, 124 aa, Artificial
  Nanobody sequence
EVQLVESGGSLVPPGGSLRLSCAASGFTFDDYAMSWVRQAPGKGLEWVSSINWSGTHTGYTDSVKGRFTISRNNANNTLYLQMNSLKSEDTAVYYCAKNWGDAGTTWFEKSGSAGQGTQVTVSS

SEQ ID NO: 2096 - protein, 124 aa, Artificial
  Nanobody sequence
EVQLVESGGSLVQPGGSLRLSCAASGFTFDDYAMTWVRQAPGKGLEWVSSINWSGTHTDYTDSVKGRFTISRNNANNTLYLQMNSLKSEDTAVYYCAKNWGDAGTTWFEKSGSAGQGTQVTVSS

SEQ ID NO: 2097 - protein, 124 aa, Artificial
  Nanobody sequence
EVQLVESGGSLVQPGGSLRLSCAASGFTFDDYAMTWVRQAPGKGLEWVSSINWSGTHTDYTGSVKGRFTISRNNANNTLYLQMNSLKSDDTAVYYCAKNWGDAGTTWFEKSGSAGPGTQVTVSS

SEQ ID NO: 2098 - protein, 124 aa, Artificial
  Nanobody sequence
EVQLVESGGSLVPPGGSLRLSCAASGFTFDDYAMSWVRQAPGKGLEWVSSINWSGTHTDYTDSVKGRFTISRNNANNTLYLQMNSLKSEDTAVYYCAKNWGDAGTTWFEKSGSAGQGTQVTVSS

SEQ ID NO: 2099 - protein, 124 aa, Artificial
  Nanobody sequence
KVQLVESGGSLVPPGGSLRLSCAASGFTFDDYAMTWVRQAPGKGLEWVSSINWSGTHTDYTDSVKGRFTISRNNANNTLYLQMNSLKSEDTAVYYCAKNWGDAGTTWFEKSGSAGQGTQVTVSS

SEQ ID NO: 2100 - protein, 124 aa, Artificial; identical to SEQ ID NO: 2095
  Nanobody sequence

SEQ ID NO: 2101 - protein, 124 aa, Artificial
  Nanobody sequence
EVQLVESGGSLVPPGGSLRLSCAASGFTFDDYGMSWVRQAPGKGLEWVSSINWSGTHTDYTDSVKGRFTISRNNANNTLYLQMNSLKSEDTAVYYCAKNWGDAGTTWFEKSGSAGQGTQVTVSS

SEQ ID NO: 2102 - protein, 124 aa, Artificial
  Nanobody sequence
EVQLVESGGSLVQPGGSLRLSCAASGFTFDDYAMTWVRQAPGKGLEWVSSINWSGTHTDYTDSVKGRFTISRNNANNTLYLQMNSLKSDDTAVYYCAKNWGDAGTTWFEKSGSAGPGTQVTVSS

SEQ ID NO: 2103 - protein, 124 aa, Artificial
  Nanobody sequence
EVQLVESGGGLVQPGGSLRLSCATSGFTFDDYAMTWVRQAPGKGLEWVSSINWSGTHTDYTDSVKGRFTISRNNANNTLYLQMNSLKSEDTAVYYCAKNWGDAGTTWFEKSGSAGQGTQVTVSS

SEQ ID NO: 2104 - protein, 124 aa, Artificial
  Nanobody sequence
EVQLVESGGSLVQPGGSLRLSCATSGFTFDDYAMTWVRQAPGKGLEWVSSINWSGTHTDYTDSVKGRFTISRNNANNTLYLQMNSLKSEDTAVYYCAKNWGDAGTTWFEKSGSAGQGTQVTVSS

SEQ ID NO: 2105 - protein, 124 aa, Artificial
  Nanobody sequence
EVQLVESGGSLVQPGGSLRLSCAASGFTFDDYAMTWVRQAPGKGLEWVSSINWSGTHTDCTDSVKGRFTISRNNANNTLYLQMNSLKSEDTAVYYCAKNWGDAGTTWFEKSGSAGQGTQVTVSS

SEQ ID NO: 2106 - protein, 124 aa, Artificial
  Nanobody sequence
EVQLVESGGSLVQPGGSLRLSCAASGFTFDDYAMTWVRQASGKGLEWVSSINWSGTHTDYADSVKGRFTISRNNANNTLYLQMNSLKSEDTAVYYCAKNWGDAGTTWFEKSGSAGQGTQVTVSS

SEQ ID NO: 2107 - protein, 124 aa, Artificial
  Nanobody sequence
EVQLVESGGSLVQPGGSLRLSCAASGFTFDDYAMTWVRQAPGKGLEWVSSINWSGTHTDYTGSVKGRFTISRNNANNTLYLQMNSLKSDDTAVYYCAKNWGDAGTTWFEKSGSAGQGTQVTVSS

SEQ ID NO: 2108 - protein, 124 aa, Artificial; identical to SEQ ID NO: 2096
  Nanobody sequence

SEQ ID NO: 2109 - protein, 124 aa, Artificial; identical to SEQ ID NO: 2101
  Nanobody sequence

SEQ ID NO: 2110 - protein, 124 aa, Artificial
  Nanobody sequence
EVQLVESGGSLVQPGGSLRLSCAASGFTFDDYAMTWVRQTPGKGLEWVSSINWSGTHTDYTDSVKGRFTISRNNANNTLYLQMNSLKSDDTAVYYCAKNWGDAGTTWFEKSGSAGPGTQVTVSS

SEQ ID NO: 2111 - protein, 124 aa, Artificial; identical to SEQ ID NO: 2090
  Nanobody sequence

SEQ ID NO: 2112 - protein, 118 aa, Artificial
  Nanobody sequence
EVQLVESGGGLVQAGGSLRLSCAASGITFSINTMGWYRQAPGKQRELVALISSIGDTYYADSVKGRFTISRDNAKNTVYLQMNSLKPEDTAVYYCKRFRTAAQGTDYWGQGTQVTVSS

SEQ ID NO: 2113 - protein, 127 aa, Artificial
  Nanobody sequence
EVQLVESGGGFVQTGGSPRLSCAASGRSFSEYAAAWFRQSPGKERDLVAGIMWDGRSLFYADSVKGRFTISRDNAKNTLHLQMNSLKPEDTAVYYCAYHKTPYTTLELNRPHAFGSWGQGTQVTVSS

SEQ ID NO: 2114 - protein, 119 aa, Artificial
  Nanobody sequence
KVQLVESGGGLVQPGGSLRLSCAASGSIFGFNDMAWYRQAPGKQRELVALISRVGVTSSADSVKGRFTISRVNAKDTVYLQMNSLKPEDTAVYYCYMDQRLDGSTLAYWGQGTQVTVSS

SEQ ID NO: 2115 - protein, 123 aa, Artificial
  Nanobody sequence
EVQLVESGGGLVQAGGSLRLSCAASGSTFSSYGMGWFRQVPGKEREFVATINWSGVTAYADSVKGRFTISRDNAKKTVYLQMNSLKPEDTARYYCGVETYGSGSSLMTEYDYWGQGTQVTVSS

SEQ ID NO: 2116 - protein, 123 aa, Artificial
  Nanobody sequence
EVQLVESGGGLVQAGGSLRLSCAVNSRTFSSYGMGWFRQAPGKEREFVATINWSGVTAYADSIKGRFTISRDNAKETVYLQMNSLKPDDTGVYYCAAETYGSGSSLMSEYDYWGQGTQVTVSS

SEQ ID NO: 2117 - protein, 123 aa, Artificial
  Nanobody sequence
EVQLVESGGGLVQAGGSLRLSCAVSSRAFSSYGMGWFRQAPGKDREFVATINWSGVTAYADSIKGRFTISRDNAKETVYLQMNSLKPEDTGVYYCAAETYGSGSSLMSEYDYWGQGTQVTVSS

SEQ ID NO: 2118 - protein, 123 aa, Artificial
  Nanobody sequence
EVQLVESGGGLVQAGGSLRLSCAVNSRTFSSYGMGWFRQAPGKEREFVATINWSGATAYADSIKGRFTISRDNAKETVYLQMNSLKPDDTGVYYCAAETYGSGSSLMSEYDYWGQGTQVTVSS

SEQ ID NO: 2119 - protein, 123 aa, Artificial
  Nanobody sequence
EVQLVESGGGLVQAGGSLRLSCAVSSRAFSSYGMGWFRQAPGKDREFVATINWSGVTAYADSIKGRFTISRDNAKETVYLQMNSLKPDDTGVYYCAAETFGSGSSLMSEYDYWGQGTQVTVSS

SEQ ID NO: 2120 - protein, 123 aa, Artificial
  Nanobody sequence
EVQLVESGGGSVQAGGSLRLSCVASEGTFSSYGMGWFRQAPGKERAFVATINWSGVTAYADSVKGRFTISRDNAKKTVYLQMNSLKPEDTAVYYCATDTYGSGSSLMNEYDYWGQGTQVTVSS

SEQ ID NO: 2121 - protein, 123 aa, Artificial
  Nanobody sequence
EVQLVESGGGSVQAGSSLTLSCVASEGTFSSYGMGWFRQAPGKERAFVATINWSGVNAYADSVKGRFTISRDNAKKTAYLQMNSLKPEDTAVYYCAAETYGSGSSLMNEYDYWGQGTQVTVSS

SEQ ID NO: 2122 - protein, 123 aa, Artificial
  Nanobody sequence
EVQLVESGGGLVQPGGSLTLSCVASEGTFSSYGMGWFRQAPGKERAFVATINWSGVNAYADSVKGRFTISRDNAKKTAYLQMNSLKPEDTAVYYCAAETYGSGSSLMNEYDYWGQGTQVTVSS

SEQ ID NO: 2123 - protein, 123 aa, Artificial
  Nanobody sequence
EVQLVESGGGSVQAGGSLRLSCAASGSTFSSYGMGWFRQAPGKERAFVATINWSGVTAYADSVKGRFTISRDNAKKTVYLQMNSLKPEDTAVYYCATETYGSGSSLMNEYDYWGQGTQVTVSS

SEQ ID NO: 2124 - protein, 123 aa, Artificial
  Nanobody sequence
EVQLVKSGGGLVQAGGSLRLSCAASERTFSSYGMGWFRQAPGKEREFVATINWSGVTAYADSVKGRFTISRDNAKKTVYLQMNSLKPEDTAVYYCAAEPYGSGSSLISEYDYWGHGTQVTVSS

SEQ ID NO: 2125 - protein, 123 aa, Artificial
  Nanobody sequence
EVQLVESGGGLVQAGGSLRLSCAASERTFSSYGMGWFRQAPGKEREFVATINWSGVTAYADSVKGRFTISRDNAKKTVYLQMNSLKPEDTAVYYCAAEPYGSGSSLISEYDYWGHGTQVTVSS

SEQ ID NO: 2126 - protein, 123 aa, Artificial
  Nanobody sequence
EVQLVESGGGSVQAGGSLRLSCAASERTFSSYGMGWFRQAPGKEREFVATINWSGVTAYADSVKGRFTISRDNAKKTVYLQMNSLKPEDTAVYYCAAEPYGSGSSLMSEYDYWGHGTQVTVSS

SEQ ID NO: 2127 - protein, 120 aa, Artificial
  Nanobody sequence
EVQLVESGGGLVQAGGSLRLSCAANGLTFRRYDMGWYRQAPGQQREWVAAISGAGDINYADSVKGRFTMARDNANHTVHLQMNSLKPEDTAVYYCNANWKMLLGVENDYWGQGTQVTVSS

SEQ ID NO: 2128 - protein, 123 aa, Artificial
  Nanobody sequence
KVQLVESGGGLVQAGGSLRLSCAASGRTFTEYSMGWFRQAPGKEREFVATISWNYGYTYYSDSVKGRFTVSRDIAENTVYLQMNTLKSEDTAVYYCAAKIGWLSIRGDEYEYWGQGTQVTVSS

SEQ ID NO: 2129 - protein, 128 aa, Artificial
  Nanobody sequence
EVQLVESGGGLVQAGGSLRLSCAASGFTFDDYGIGWFRQASGKEREGVSCITSSDGSTYYADSVKGRFTISSDNAKNTVYLQMNSLKPEDTAVYYCAALPFVCPSGSYSDYGDEYDYWGQGTQVTVSS

SEQ ID NO: 2130 - protein, 121 aa, Artificial
  Nanobody sequence
EVQLVESGGGLVQPGGSLRLSCAASGFAFSSYAMSWVRQAPGKGLEWVSAVDSGGGRTDYAHSVKGRFTISRDNAKNTLYLQMSSLKPEDTALYYCTKHVSDSDYTEYDYWGQGTQVTVSS

SEQ ID NO: 2131 - protein, 125 aa, Artificial
  Nanobody sequence
EVQLVESGGGLVQAGGSLRLSCTASGRTSSTSAMGWFRQAPGKEREFVATISRGGSATYYADSLKGRFTISRDNAKNTLYLQMNSLKPEDTAVYYCAARRSSLYTSSNVFEYDYWGQGTQVTVSS

SEQ ID NO: 2132 - protein, 113 aa, Artificial
  Nanobody sequence
EVQLVESGGGLVQAGGSLRLSCVTSRRPASTRTMAWYRQAPGKQRDWVATISSHGLPVYADSVKGRFTVSRDNANNTVYLQMNTLKPEDTAVYYCRDVNADYWGQGTQVTVSS

SEQ ID NO: 2133 - protein, 113 aa, Artificial
  Nanobody sequence
EVQLVESGGGLVQPGGSLRLSCAASRIPFSTRTMAWYRQAPGKQRDWVATIGTSGPPRYADSVKGRFTVSRDNAKNTVYLQMNSLKAEDTAVYYCWDVNADYWGQGTQVTVSS

SEQ ID NO: 2134 - protein, 113 aa, Artificial
  Nanobody sequence
EVQLVESGGGLVQAGGSLRLSCVTSRRPASTRTMAWYRQAPGKQRDWVATISSHGLPVYADSVKGRFTVSRDNANNTVYLQMNTLKPEDTAVYYCRDVNADYWGQGTPVTVSS

SEQ ID NO: 2135 - protein, 113 aa, Artificial
  Nanobody sequence
EVQLVESGGGLVQAGGSLRLSCVASRIPFSSRTMAWYRQAPGKQRDWVATISARGMPAYEDSVKGRFTVSRDNDKNTLYLQMNSLKPEDTAVYYCRDVNADYWGQGTQVTVSS

SEQ ID NO: 2136 - protein, 113 aa, Artificial
  Nanobody sequence
EVQLVESGGGLVQAGGSLRLSCVTSRRPASTRTMAWYRQAQGKQRDWVATISSHGLPVYADSVKGRFTVSRDNANNTVYLQMNTLKPEDTAVYYCRDVNADYWGQGTQVTVSS

SEQ ID NO: 2137 - protein, 112 aa, Artificial
  Nanobody sequence
EVQLVESGGGLVQAGGSLNLSCVASGIPFSTRTMAWYRQAPGKPRDWVATIRNGAPVYADSVKGRFTVSRDNAKNTLYLQMNSLKPEDTATYLCRDVNGDIWGQGTQVTVSS

SEQ ID NO: 2138 - protein, 112 aa, Artificial
  Nanobody sequence
EVQLVESGGGLVQAGGSLNLSCVASGIPFSTRTMAWYRQPPGNERDWVATIRSGAPVYADSVKGRFTVSRDNAKNTLYLQMNSLEPEDTATYYCWDVNGDIWGQGTPVTVSS

SEQ ID NO: 2139 - protein, 112 aa, Artificial
  Nanobody sequence
EVQLVESGGGLVQAGGSLNLSCVASGIPFSTRTMAWYRQTPGKSRDWVATIRSGTPVYADSVKGRFTVSRDNAKNTLYLRMNSLKSEDSATYTCRAVNADIWGQGTQVTVSS

SEQ ID NO: 2140 - protein, 113 aa, Artificial
  Nanobody sequence
EVQLVESGGGLVQPGGSLRLSCVASRIPASIRTMAWYRQTPGNQRDWLATIGSSGTPAYADSVKGRFTVSRDNAKNTVYLQMNSLKPEDTAVYYCRDVNGDYWGQGTQVTVSS

SEQ ID NO: 2141 - protein, 113 aa, Artificial
  Nanobody sequence
EVQLVESGGGLVQAGGSLRLSCVASRIPASIRTMAWYRQAPGKQRDWVATIGTGGTPAYADSFKGRFTVSRDNANHTVYLQMNSLKPEDTAVYYCRDVNGDYWGQGTQVTVSS

SEQ ID NO: 2142 - protein, 113 aa, Artificial; identical to SEQ ID NO: 2140
  Nanobody sequence

SEQ ID NO: 2143 - protein, 113 aa, Artificial
  Nanobody sequence
EVQLVESGGGLVQPGGSLKLSCVASTIPASIRTMAWYRQTPGNQRDWLATIGSSGTPAYADSVKGRFTVSRDNAKNTVYLQMNSLKPEDTAVYYCRDVNGDYWGQGTQVTVSS

SEQ ID NO: 2144 - protein, 113 aa, Artificial
  Nanobody sequence
EVQLVESGGGLVQAGGSLRLSCVASGIPFRSRTMAWYRQAPGKTRDWVATIGTHGTPLYADSVKGRFTVSRDNAKNTLYLQMNSLKPEDTAVYYCWDVNGDYWGQGTQVTVSS

SEQ ID NO: 2145 - protein, 120 aa, Artificial
  Nanobody sequence
EVQLVESGGGLVQAGESLRLSCATSGITFKRYVMGWYRQGPGKQRELVATVNDGGTTSYADSVKGRFAISRDNAKNTAYLQMNSLKAEDTAVYYCNAVWKLPRFVDNDYWGQGTQVTVSS

SEQ ID NO: 2146 - protein, 120 aa, Artificial
  Nanobody sequence
EVQLMESGGGLVQAGGSLRLSCAANGLTFRRYDMGWYRQAPGQQREWVAAISGAGDINYADSVKGRFTMARDNANHTVHLQMNSLKPEDTAVYYCNANWKMLLGVENDYWGQGTQVTVSS

SEQ ID NO: 2147 - protein, 120 aa, Artificial; identical to SEQ ID NO: 2127
  Nanobody sequence

SEQ ID NO: 2148 - protein, 115 aa, Artificial
  Nanobody sequence
EVQLVESGGGLVQPGGSLRLSCAASGLGIAFSRRTMAWYRQAPGKQRDWVATIAGDGSTVYADSMKGRFTISRDNAENTVYLQMNSLKPEDTAVYYCWDVNRDYWGQGTQVTVSS

SEQ ID NO: 2149 - protein, 115 aa, Artificial
  Nanobody sequence
EVQLVESGGGLVQPGGSLRLSCAASGLGIAFSRRTMAWYRQAPGKQRDWVATIAGDGSTVYADSMKGRFTISRDNAKNTVYLQINSLKPEDTAVYYCWDVNRDYWGQGTQVTVSS

SEQ ID NO: 2150 - protein, 113 aa, Artificial
  Nanobody sequence
EVQLVESGGGLVQAGGSLRLSCVASGIAQSIRVMAWYRQPPGKQRDWVGTISSDGTANYADSVKGRFTISRDNAKKTMYLQMNSLKPDDTAVYYCRDVNRDYWGQGTQVTVSS

SEQ ID NO: 2151 - protein, 113 aa, Artificial
  Nanobody sequence
EVQLVESGGGLVQAGGSLRLSCAASGIAFRIRTMAWYRQAPGKQRDWVATSDSGGTTLYADSVKGRFTVSRDNAENTVYLQMNSLKPEDTAVYYCRDVNRDYWGQGTQVTVSS

SEQ ID NO: 2152 - protein, 112 aa, Artificial
  Nanobody sequence
EVQLVESGGGLVQAGGSLRLSCVASGIPSIRAIAWYRQAPGKQRDWVATSGTGYGATYDDSVKGRFTLSRDNAKNTVYLQMNSLKPEDTAVYYCRDVNRDYWGQGTQVTVSS

SEQ ID NO: 2153 - protein, 115 aa, Artificial
  Nanobody sequence
EVQLMESGGGLVQPGGSLRLSCAASGLGIAFSRRTMAWYRQAPGKQRDWVATIAGDGSTVYADSMKGRFTISRDNAENTVYLQMNSLKPEDTAVYYCWDVNRDYWGQGTQVTVSS

SEQ ID NO: 2154 - protein, 113 aa, Artificial
  Nanobody sequence
EVQLVESGGGLVQAGGSLRLSCAASGIAFRIRTMAWYRQAPGKQRDWVATIGSDGTTIYADSVKGRFTLSRHNAENTVYLQMNSLKPEDTAVYYCRDVNRDYWGQGTQVTVSS

SEQ ID NO: 2155 - protein, 114 aa, Artificial
  Nanobody sequence
EVQLVESGGGLVQAGGSLRLSCVVSGIPSSIRAMAWYRQAPGRQRDWVATIYSPSGSAVYADSVKGRFTISSDNAKSTIYLQMNSLKPDDTAVYYCRDVNRDYWGQGTQVTVSS

SEQ ID NO: 2156 - protein, 114 aa, Artificial
  Nanobody sequence
EVQLVESGGGSVQAGGSLRLSCVVSGIPSSIRAMAWYRQAPGRQRDWVATIYSRSGGAVYADSVKGRFTISSDNAKNTIYLQMNSLKPDDTAVYYCRDVNRDYWGQGTQVTVSS

SEQ ID NO: 2157 - protein, 112 aa, Artificial
  Nanobody sequence
EVQLVESGGGLVQAGGSLRLSCVASGIPSIHAMAWYRQAPGKQRDWGATTYSRGGTTYNDSAKGRFTISRDNAKKTVYLQMNSLKPEDTAVYYCRDVNRDYWGQGTQVTVSS

SEQ ID NO: 2158 - protein, 113 aa, Artificial
  Nanobody sequence
EVQLVESGGGLVQPGGSLRLSCAASGIIGTIRTMAWYRQAPGKQRDWVASIGTRGAPVYADSVNGRFTISRDGATNTVFLQMNNLKPEDTAVYYCRDVNRDYWGQGTQVTVSS

SEQ ID NO: 2159 - protein, 113 aa, Artificial
  Nanobody sequence
EVQLVESGGGLVQAGGSLRLPCAASGIAFRIRTMAWYRQAPGKQRDWVATSDSGGTTLYADSVKGRFTVSRDNAENTVYLQMNSLKPEDTAVYYCRDVNRDYWGQGTQVTVSS

SEQ ID NO: 2160 - protein, 113 aa, Artificial
  Nanobody sequence
EVQLVESGGGLVQAGGSLRLSCAASGIAFRIRTMAWYRQAPGKQRDWVATSDSGGTTLYADSVKGRFTVSRDNADNTVYLQMNSLKPEDTAVYYCRDVNRDYWGQGTQVTVSS

SEQ ID NO: 2161 - protein, 114 aa, Artificial
  Nanobody sequence
EVQLVESGGGLVQAGGSLRLSCVVSGIPSSIRAMAWYRQAPGRQRDWVATIYSPSGSAVYADSVKGRFTISSDNAKSTIYLQMNSLEPDDTAVYYCRDVNREYWGQGTQVTVSS

SEQ ID NO: 2162 - protein, 114 aa, Artificial
  Nanobody sequence
EVQLVESGGGLVQAGGSLRLSCVVSGIPSTIRAMAWYRQAPGRQRDWVATIYSPSGSAVYADSVKGRFTISSDNAKKTIYLQMNSLKPDDTAVYYCRDVNREYWGQGTQVTVSS

SEQ ID NO: 2163 - protein, 114 aa, Artificial
  Nanobody sequence
EVQLVESGGGLVQAGGSLRLSCVVSGIPSSIRAMAWYRQAPGRQRDWVATIYSPSGSAVYADSVKGRFTISSDNAKSTIYLQMNSLKPDDTAVYYCRDVNREYWGQGTQVTVSS

SEQ ID NO: 2164 - protein, 123 aa, Artificial
  Nanobody sequence
EVQLVESGGGLVQAGGSLRLSCAASGRTFSDDAMGWFRQAPGKERECVASLYLNGDYPYYADSVKGRFTISRDNAKNAVILQMNNLKTEDTAVYYCAAKPGWVARDPSQYNYWGQGTQVTVSS

SEQ ID NO: 2165 - protein, 123 aa, Artificial
  Nanobody sequence
EVQLVESGGGLVQAGGSLRLSCAASGRAFKDDAVGWFRQAPGKERECVASMYLDGDYPYYADSVKGRFTISRDNAKNAVILQMNNLKTEDTAVYYCAAKPGWVARDPSEYNYWGQGTQVTVSS

SEQ ID NO: 2166 - protein, 113 aa, Artificial
  Nanobody sequence
EVQLVESGGGLVQTGGSLRLSCAASGSTFRTDMMGWYRQAPGKQREFVASITKFGSTNYADSVKGRFTISNDNAKDTVYLQMNSLKSEDTAVYYCRNFNRDLWGQGTQVTVSS

SEQ ID NO: 2167 - protein, 113 aa, Artificial
  Nanobody sequence
EVQLVESGGGLVQAGGSLKLSCVNSGIPSTLRAMAWYRQAPGRQRDWVATSSNTGGTTYDDSVKGRFTISRDNAKNTVYLQMNSLKPEDTGVYYCRDVNRDLWGQGTQVTVSS

SEQ ID NO: 2168 - protein, 123 aa, Artificial
  Nanobody sequence
EVQLVESGGGLVQPGGSLRLSCAASSVITLDSNAIGWFRQAPGKEREEVSCIASSDGSTYYAESVKGRFTISKDYTRNTVYLQVNSLKPEDTAVYHCATDANPNCGLNVWNSWGQGTQVTVSS

SEQ ID NO: 2169 - protein, 116 aa, Artificial
  Nanobody sequence
EVQLVESGGGLVQAGGSLTLSCAASGSTSSLDIMAWYRQAPEKQRELVASVSGGGNSDYASSVKGRFTISGDTAKSTLYLQMNSLKPEDTAMYYCYGRDYYYMPFWGQGTQVTVSS

SEQ ID NO: 2170 - protein, 113 aa, Artificial
  Nanobody sequence
EVQLVESGGGLAQAGGSLSLSCAASGRFFSTRVMAWYRQTPGKQREFVASMRGSGSTNYADSARGRFAISRDNAKNTVYLQMNSLKPEDTAVYYCRDINEDQWGQGTQVTVSS

SEQ ID NO: 2171 - protein, 113 aa, Artificial
  Nanobody sequence
EVQLVESGGGLVQAGGSLSLSCAASGRFFSTRVMAWYRQTPGKQREFVASMRGSGSTNYADSVRGRFAISRDNAKNMVYLQMNTLKPEDTAVYYCRDINEDQWGQGTQVTVSS

SEQ ID NO: 2172 - protein, 113 aa, Artificial
  Nanobody sequence
EVQLVESGGGLVQAGGSLSLSCAASGRFFSTRVMAWYRQTPGKQREFVASMRGSGSTNYADSARGRFAISRDNAKNTVYLQMNSLKPEDTAVYYCRDINEDQWGQGTQVTVSS

SEQ ID NO: 2173 - protein, 113 aa, Artificial
  Nanobody sequence
EVQLVESGGGLVQAGGSLSLSCVASGRFFSTRVMAWYRQTPGKQREFVASMRGSGSTNYADSVRGRFAISRDNAKNTVYLQMNTLKPEDTAVYYCRDINEDQWGQGTQVTVSS

SEQ ID NO: 2174 - protein, 113 aa, Artificial
  Nanobody sequence
EVQLVESGGGLVQAGGSLSLSCSASGRFFSTRVMAWYRQTPGNQREFVATIHSSGSTIYADSVRGRFAISRDNAKNTVYLQMRSLKPEDTAVYYCRDINADQWGQGTQVTVSS

SEQ ID NO: 2175 - protein, 113 aa, Artificial
  Nanobody sequence
EVQLVESGGGLVQAGGSLTLSCTASETTVRIRTMAWYRQPPGNQREWVATIGSNGFATYPDSVKGRFTISRDNAKNTVYLQMNSLKPEDTAVYYCRDINRDIWGQGSQVTVSS

SEQ ID NO: 2176 - protein, 113 aa, Artificial
  Nanobody sequence
EVQLVESGGGLVQAGGSLTLSCAPSESTVSFNTVAWYRQAPGEQREWVATISRQGMSTYPDSVKGRFTISRDNAKNTVYLQMNNLKPEDTAVYYCRDINHDIWGRGSQVTVSS

SEQ ID NO: 2177 - protein, 113 aa, Artificial
  Nanobody sequence
EVQLVESGGGLVQAGGSLRLSCAASGIISSFRTMAWYRQAPGKQRDWVATIGSDGLANYADSVKGRFTISRDNAKKTVYLQMNSLKPEDTAVYFCRDINRDYWGQGTQVTVSS

SEQ ID NO: 2178 - protein, 113 aa, Artificial
  Nanobody sequence
EVQLVESGGGLVQAGGSLRLSCVVSGVFGPIRAMAWYRQAPGKQRDWVATIGSSGHPVYTDSVKGRFTFSKDGAKNTVYLQMNSLKPEDTAVYYCRDINRDYWGQGTQVTVSS

SEQ ID NO: 2179 - protein, 115 aa, Artificial
  Nanobody sequence
EVQLVESGGGLVQPGGSLRLSCAASGIGIAFSSRTMAWYRQAPGKQRDWVATIGSGGTTNYADSVKGRFTISRDNAKNTVYLQMNSLKPEDTAVYYCRDINRDYWGQGTQVTVSS

SEQ ID NO: 2180 - protein, 113 aa, Artificial
  Nanobody sequence
EVQLVESGGGLVQPGGSLRLSCAASGIIGSFRTMAWYRQAPGNQRDWVATIGSAGLASYADSVRGRFTLSRDNAKKTVYLQMNSLKPEDTAIYYCRDINGDYWGQGTQVTVSS

SEQ ID NO: 2181 - protein, 115 aa, Artificial
  Nanobody sequence
EVQLVESGGGLVQAGGSLRLSCAASGIISSFRTLAWYRQAPGKQRDWVATISSAGGTAYADAVKGRFTISISRDNVEYTVDLQMDSLKPEDTAVYYCRDINGDYWGQGTQVTVSS

SEQ ID NO: 2182 - protein, 115 aa, Artificial
  Nanobody sequence
EVQLVESGGGLVQPGGSLRLSCAASGLGIAFSRRTMAWYRQAPGKQRDWVATIAGDGSTVYADSMKGRFTISRDNAKNTVYLQVNSLKPEDTAVYYCWDTNGDYWGQGTQVTVSS

SEQ ID NO: 2183 - protein, 120 aa, Artificial
  Nanobody sequence
EVQLVESGGGLVQPGGSLRLSCAGSGFTFSNYAMTWVRQAPGKGLEWVSGVGGDGVGSYADSVKGRFTISRDNAKNTLYLQMNSLKPEDTALYYCTKDISTFGWGPFDYWGQGTQVTVSS

SEQ ID NO: 2184 - protein, 117 aa, Artificial
  Nanobody sequence
EVQLVESGGGLVQAGGSLRLSCVASKMTFMRYTMGWYRQAPGKQRDLVASIDASGGTNYADSVKGRFTISRDNAKNTVYLEMNSLKPEDTGVYYCNGRWDIVGAIWWGQGTQVTVSS

SEQ ID NO: 2185 - protein, 117 aa, Artificial
  Nanobody sequence
EVQLVESGGGLVQAGGSLRLSCVASKMTFMRYTMGWYRQAPGKQRDLVASIDSSGGTNYADSVKGRFTISRDNAKNTVYLEMNSLKPEDTGVYYCNGRWDIVGAIWWGQGTQVTVSS

SEQ ID NO: 2186 - protein, 117 aa, Artificial
  Nanobody sequence
EVQLVESGGGLVQAGGSLRLSCVASKITFRRYIMDWYRQAPGKQRELVASINSDGSTGYTDSVKGRFTISRDNTKNTLDLQMNSLKPEDTAVYYCHGRWLEIGAEYWGQGTQVTVSS

SEQ ID NO: 2187 - protein, 117 aa, Artificial
  Nanobody sequence
EVQLVESGGGLVQAGGSLKLSCVASGITFFRYTMGWYRQAPGKERELVAEISSADEPSFADAVKGRFTISRDNAKNTVVLQMNGLKPEDTAVYYCKGSWSYPGLTYWGKGTLVTVSS

SEQ ID NO: 2188 - protein, 117 aa, Artificial
  Nanobody sequence
EVQLVESGGGLVQAGGSLRLSCAASGITFRRYDMGWYRQFPGKERELVATILSEGDTNYVDPVKGRFTISRDNAKNTVYLQMNDLKPEDTAVYYCNGVWRAIGRTYWGQGTQVTVSS

SEQ ID NO: 2189 - protein, 118 aa, Artificial
  Nanobody sequence
EVQLVESGGGLVQAGGSLRLSCAASASIFGFDSMGWYRQAPGNERILVAIISNGGTTSYRDSVKGRFTIARDNAKNTVSLQMNSLKPEDTAVYYCNLDRRSYNGRQYWGQGTQVTVSS

SEQ ID NO: 2190 - protein, 122 aa, Artificial
  Nanobody sequence
EVQLVESGGGLVQAGGSLRLSCAASGNIFSHNAMGWYRQAPGKQRELVTYITINGIANYVDSVKGRFTISRDNTKNTMYLQMVSLKPEDTAVYYCNVGGREYSGVYYYREYWGQGTQVTVSS

SEQ ID NO: 2191 - protein, 121 aa, Artificial
  Nanobody sequence
EVQLVESGGGLVQAGDSLRLSCAASGRALDTYVMGWFRQAPGDGREFVAHIFRSGITSYASSVKGRFTISRDNAKNTVYLQMASLKPEDTAAYYCAARPSDTTWSESSASWGQGTQVTVSS

SEQ ID NO: 2192 - protein, 121 aa, Artificial
  Nanobody sequence
EVQLVESGGGLVQPGGSLRLSCAASGFTFDDYSMSWVRQATGKGLEWVSGISWNGGSTNYADSVKGRFTISRDNVKNTLYLQMNSLKSEDTAVYYCAKDLGNSGRGPYTNWGQGTQVTVSS

SEQ ID NO: 2193 - protein, 122 aa, Artificial
  Nanobody sequence
EVQLVESGGGLVQPGGSLKLSCAASGFTFSSYRMYWVRQAPGKGLEWVSAIKPDGSITYYADSVKGRFTISRDNAKNTVYLQMNSLKPEDTAVYYCATDCGVPGFGWTFSSWGQGTQVTVSS

SEQ ID NO: 2194 - protein, 117 aa, Artificial
  Nanobody sequence
EVQLVESGGGLVQAGGSLRLSCAASGSTFSINRMAWYRQSPGKQRELVAAVDNDDNTEYSDSVAGRFTISRDNAKNAVHLQMNSLRLEDTAVYYCNAKQLPYLQNFWGQGTQVTVSS

SEQ ID NO: 2195 - protein, 117 aa, Artificial
  Nanobody sequence
EVQLVESGGGLVQAGGSLRLSCAASGSTFSINRWGWYRQAPGKQRELVAAIDDGGNTEYSDFVNGRFTISRDNPETAVHLQMNSLKLEDTAVYYCNAKQLPYLQNFWGQGTQVTVSS

SEQ ID NO: 2196 - protein, 114 aa, Artificial
  Nanobody sequence
EVQLVESGGGLVQAGGSLSLSCAASATLHRFDNNWYRQAPGKQRELVATIAHDGSTNYANSVKGRFTISRDNARDTLFLQMHALQPEDTAVYMCNLHRWGLNYWGQGTQVTVSS

SEQ ID NO: 2197 - protein, 122 aa, Artificial
  Nanobody sequence
EVQLVESGGGLVQPGGSLRLSCAASGFTFSSYAMSWVRQAPGKGLEWVSAISSGGGSITTYADSVKGRFTISRDNAKNTLYLQMSSLKPEDTALYYCAKARSSSSYYDFGSWGQGTQVTVSS

SEQ ID NO: 2198 - protein, 122 aa, Artificial
  Nanobody sequence
EVQLVESGGGLVQPGGSLRLSCAASGFTFSSYAMSWVRQAPGKGLEWVSAISSGGGSITTYADSVKGRFTISTDNAKNTLYLQMSSLKPEDTALYYCAKARSSSSYYDFGSWGQGTQVTVSS

SEQ ID NO: 2199 - protein, 122 aa, Artificial
  Nanobody sequence
EVQLVESGGGLVQPGGSLRLSCAASGFTLDYCAIGWFRQAPGKEREGVSCISSSDGSTYYADSVKGRFTISRDNAKNTVYLQMNSLKPEDTAVYYCATDRGSGTCYADFGSWGQGTQVTVSS

SEQ ID NO: 2200 - protein, 120 aa, Artificial
  Nanobody sequence
EVQLVESGGGLVQPGGSLRLSCAASGFIFDDYAMSWVRQAPGKGLEWVSSINWSGTHTDYAEDMKGRFTISRDNAKKTLYLQMNSLQSEDTAVYYCAKGWGPAVTSIPVATLGTQVTVSS

SEQ ID NO: 2201 - protein, 113 aa, Artificial; identical to SEQ ID NO: 2175
  Nanobody sequence

SEQ ID NO: 2202 - protein, 113 aa, Artificial; identical to SEQ ID NO: 2175
  Nanobody sequence

SEQ ID NO: 2203 - protein, 113 aa, Artificial; identical to SEQ ID NO: 2175
  Nanobody sequence

SEQ ID NO: 2204 - protein, 113 aa, Artificial; identical to SEQ ID NO: 2175
  Nanobody sequence

SEQ ID NO: 2205 - protein, 122 aa, Artificial
  Nanobody sequence
EVQLVESGGGLVQPGGSLRLSCAASGRIFYPMGWFRQAPGKEREFVAAIGSGDIITYYADSVKGRFTISRDNAKNTVYLQMNSLKPEDTAVYYCASSRDYSRSRDPTSYDRWGQGTQVTVSS

SEQ ID NO: 2206 - protein, 122 aa, Artificial
  Nanobody sequence
EVQLVESGGGLVQPGGSLRLSCAASGFTFDDYATSWVRQAPGKGPEWVSAINSGGGSTYYADSVKGRFTISRDNAKNTLYLQMNSLKPEDTAVYYCARPRGSSLYLLEYDYWGQGTQVTVSS

SEQ ID NO: 2207 - protein, 120 aa, Artificial
  Nanobody sequence
EVQLVESGGGLVQAGGSLRLSCAASGRTFNAMGWFRQAPGKEREFVAAISRSPGVTYYADSVKGRFTTSRDNAKNTVYLQMNDLKPEDTAVYYCAADFYLATLAHEYDYWGQGTQVTVSS

SEQ ID NO: 2208 - protein, 122 aa, Artificial
  Nanobody sequence
EVQLVESGGGLVQAGGSLRLSCAASGRTFSSYAMAWFRQAPGTEREFIAGIRWSDGSTYYADSVKGRFTISRDNAKNTVYLQMNSLKPEDTAVYYCAADFYVSTLAHEYDYWGQGTQVTVSS

SEQ ID NO: 2209 - protein, 122 aa, Artificial
  Nanobody sequence
KVQLVESGGGLVQAGGSLRLSCAASGRTFSSYAMAWFRQAPGTEREFIAGIRWSDGSTYYADSVKGRFTISRANAKNTVYLQMNGLKPEDTAVYYCAADFYVSTLAHEYDYWGQGTQVTVSS

SEQ ID NO: 2210 - protein, 122 aa, Artificial
  Nanobody sequence
EVQLVESGGGLVQAGGSLRLSCAASGRTFSSYAMAWFRQAPGKEREFVGGIRWSDGSTYYADSVKGRFTISRDNAKITVYLQMNSLKPEDTAVYYCAADFYVSTLAHEYDYWGQGTQVTVSS

SEQ ID NO: 2211 - protein, 123 aa, Artificial
  Nanobody sequence
EVQLVESGGGLVQAGGSLRLSCAASGRTFSSYAMGWFRQAPGKERAFVAAIRWSGGNTYYADSVKGRFTISRDNAKNTVYLQMNSLKPEDTAVYYCAADTFTLSTLSHEYDYWGQGTQVTVSS

SEQ ID NO: 2212 - protein, 123 aa, Artificial
  Nanobody sequence
EVQLVESGGGLVQAGGSLRLSCVASGRTFSNYALAWFRQAPGKEREFVAAINWRSGGSTYYADSVKGRFTISRDNAKNTVYLQMNSLKPEDTAVYYCAADLIVATLPGEYDYWGQGTQVTVSS

SEQ ID NO: 2213 - protein, 122 aa, Artificial
  Nanobody sequence
EVQLVESGGGLVQAGGSLRLSCAASGRTFSRFAMGWFRQAPGKEREFVAAVRWSDDYTYYADSVKGRFTISRDNAKNTVYLQMNSLSPEDTAVYYCAADEILATLPHEYDYWGQGTQVTVSS

SEQ ID NO: 2214 - protein, 124 aa, Artificial
  Nanobody sequence
EVQLVESGGGLVQAGGSLRLSCAASGRTFSSYAMAWFRQAPGKEREFVAGINKSGGITHSADSVKGRFTISRDNAKNTVYLQMNSLKPEDTAVYYCAADAYTVIATLPHEYDYWGQGTQVTVSS

SEQ ID NO: 2215 - protein, 123 aa, Artificial
  Nanobody sequence
EVQLVESGGGLVQAGGSLRLSCEASGLTISSLTMAWFRQAPGKEREFVANIKWSGDRIVYADSVKGRFTISRDSAKNAVNLQMELVESDDTAVYYCAAKHSTVAGLTHEYDYWGQGTQVTVSS

SEQ ID NO: 2216 - protein, 120 aa, Artificial
  Nanobody sequence
EVQLVESGGGLVQPGGSLRLSCAASGSAFSIKSMGWYRQAPGKQRELAAVIISSGTTTYADSVKGRFTISRDSAKNTVYLQMDSLKPEDTAVYVCNAVYVSTWGNGYDYWGQGTQVTVSS

SEQ ID NO: 2217 - protein, 126 aa, Artificial
  Nanobody sequence
EVQLVESGGGLVQAGGSLGLSCAAAGRTFSSSLMGWFRQAPGKEREFVAAITDNGGSTYYADSVKGRFTISRDNAKNSVYLQMNSLKPEDTAIYYCAARRSGYYSLSTSPHQYAYWGQGTQVTVSS

SEQ ID NO: 2218 - protein, 124 aa, Artificial
  Nanobody sequence
EVQLVESGGGLVQAGGSLRLSCAASGRAFSSYAMGWFRQAPGKERDFVAAITSSGSTNYADSVKGRFTISRDNAKNTVYLQMNSLKPEDTAVYYCGARVNYAAYSRLEHDYHYWGQGTQVTVSS

SEQ ID NO: 2219 - protein, 125 aa, Artificial
  Nanobody sequence
EVQLVESGGGLVQAGGSLRLSCATSGRTFSTYASMGWFRQTPGKEREFVAAITSSGSTNYADSVKGRFTISRDNAKNTVYLQMNSLKPEDTAVYYCGARVNYAAYSRLEHDYHYWGQGTQVTVSS

SEQ ID NO: 2220 - protein, 116 aa, Artificial
  Nanobody sequence
EVQLVESGGGLVQPGGSLRLSCAASGNIDGIITMGWYRQRPGKPREWVGTINSGGDTNYAGSVKGRFTIARDDAKNTMYLQMNGMKPEDTAVYYCKMNRAGIYEYWGQGTQVTVSS

SEQ ID NO: 2221 - protein, 123 aa, Artificial
  Nanobody sequence
EVQLVESGGGLVQTGGSLRLSCAASGPTFSDYAIGWFRQAPGKEREFVAAISSSGISTIYGDSVKGRFDISRDNAKNTVYLQMNRLKPEDTAVYYCAARLFMATPNQGQYYYWGQGTQVTVSS

SEQ ID NO: 2222 - protein, 123 aa, Artificial
  Nanobody sequence
EVQLVESGGGLVQAGDSLRLSCAASGFTFSNHIMGWFRQAPGKERELIAHITWNGGSTYYADSVKGRFAISRDNALNTVYLQMNSLKPEDTAVYYCAARPSYSTNNVKSYRYWGQGTQVTVSS

SEQ ID NO: 2223 - protein, 124 aa, Artificial
  Nanobody sequence
EVQLVESGGGLVQAGSSLRLSCALSGRTFSDYAIGWFRQAPGKEREFVAAISGWSGGTTNYADSVKGRFTISRDNGKNTVDLRMNSLKPEDTAVYYCAARPAVVHTRKESYPYWGQGTQVTVSS

SEQ ID NO: 2224 - protein, 125 aa, Artificial
  Nanobody sequence
EVQLVESGGGLVQAGGSLRLSCIASERTFSSAGVGWFRQAPGKERDFVAAISWNGVTIYYADSVKGRFTISRDNAKNTVYLQMNSLKPEDTAVYYCAARINYSVLTTTSSSYHYWGQGTQVTVSS

SEQ ID NO: 2225 - protein, 123 aa, Artificial
  Nanobody sequence
EVQLVESGGGLVQPGDSLRLSCSASEGTLSRSRVAWFRQAPGKEREFVTVISGVGTSYADSVKGRFTISRDDAKNTVYLQMNSLKAEDTAIYYCAADFRSTWLSSSGSSYTYWGQGTQVTVSS

SEQ ID NO: 2226 - protein, 121 aa, Artificial
  Nanobody sequence
EVQLVESGGGLVQPGGSLTLSCVGSGRRFSADVMGWYRQAPGKQREFVASISSGSAINYADSVKGRFTVSRDNAQNTVYLQMNSLKIEDTGVYYCNARRIVNVEGAYRDYWGQGTQVTVSS

SEQ ID NO: 2227 - protein, 121 aa, Artificial
  Nanobody sequence
EVQLVESGGGLVQPGGSLPLSCAASGSIFRMNDMGWYRQAPGKQRERVATLTSAGNTNYADSVKGRFTISGDDARNTVYLQMNSLNPEDTAVYYCNAKVVVAVEGAKYDYWGQGTQVTVSS

SEQ ID NO: 2228 - protein, 122 aa, Artificial
  Nanobody sequence
EVQLVESGGGLAQAGGSLRLSCAVFGRSRYGMAWFRRAPGKEREFVAGIAWNGASIGSADSVRGRFTISRDNSENTVYFEMGSLKPEDTAVYYCAICRISWCAGAESDYGYWGQGTQVTVSS

SEQ ID NO: 2229 - protein, 127 aa, Artificial
  Nanobody sequence
EVQLVESGGGQVQAGGSLRLSCTESGRAFNTRAMGWFRQAPEKEREFVAGITMSGFNTRYADSVKGRFTISRDNAKGTVYLQMSSLKPEDTAVYYCAADSITDRRSVAVAHTSYYYWGQGTQVTVSS

SEQ ID NO: 2230 - protein, 123 aa, Artificial
  Nanobody sequence
EVQLVESGGGLVQAGGSLGLSCAASGRTFSNYAMGWFRQAPGKEREFVAGISWSGGHTFYADSVKGRFTISRDNTKNTVYLQMNSMRPEDTAVYYCAARLSSVAVASTRYDYWGQGTQVTVSS

SEQ ID NO: 2231 - protein, 125 aa, Artificial
  Nanobody sequence
EVQLVESGGGLVQAGDSLRLSCVASGGTFGSYAMGWFRQAPGKEREFVATIDWSGDTAFYADSVKGRFTISRDIANDVVYLQMNSLEPEDTAVYYCARNRQSGVASENLRLYTYWGQGTQVTVSS

SEQ ID NO: 2232 - protein, 123 aa, Artificial
  Nanobody sequence
EVQLVESGGGLAQAGDSLRLSCVDSGSSFSAYAMGWFRQAPGKEREFVAAVSWDGRNTYYADSVKGRFTISRDNAKNTLYLQTTSLRPEDTGVYYCAEDKQSGVSVNPKYAYWGQGTQVTVSS

SEQ ID NO: 2233 - protein, 118 aa, Artificial
  Nanobody sequence
EVQLVESGGGLVQAGGSLRLSCAVSGGTFESDTMAWFRQAPGKEREFVARVSWIRTTYYSDSVKGRFTISKDNAKNTVYLQMNSLKPEDTAVYYCAAQTLGRSLYDYWGQGTQVTVSS

SEQ ID NO: 2234 - protein, 126 aa, Artificial
  Nanobody sequence
EVQLVESGGGLVQAGGSLRLSCAASGRTFSSNAMAWFRQAPGNERELVSAIGWSGASTYYIDSVEGRFTISRDNAKNTVYLQMNSLKPEDTAVYYCAASRYSGGVATARRSEYHYWGQGTQVTVSS

SEQ ID NO: 2235 - protein, 125 aa, Artificial
  Nanobody sequence
EVQLVESGGGLVQAGDSLRLSCVASGDSFNTYTMGWFRQAPGKEREFVAAIRWSGGTTFYGDSVKGRFTISRDYAKNTWYLQMNTLKPEDTAAYYCAAVATYSRNVGSVRNYDYWGQGTQVTVSS

SEQ ID NO: 2236 - protein, 126 aa, Artificial
  Nanobody sequence
EVQLVESGGGLVQAGGSLRLSCVVSEGTFSSYSMGWFRQAPGKDREFVSAITWNGTRTYYRDSVKGRFTISRDNAKNTVQLQMNSLKPEDTAVYYCAVSQPLNYYTYYDARRYDYWGQGTQVTVSS

SEQ ID NO: 2237 - protein, 124 aa, Artificial
  Nanobody sequence
EAQLVESGGGLVQAGGSLRLSCTASGRTYSTTMGWFRQAPGKEREFVAAIRWSGGSAFYADSVKGRFTISRDNAKNTVYLQMTSLMPEDTAVYYCADTPVYYQRYYDQNAYDYWGQGTQVTVSS

SEQ ID NO: 2238 - protein, 118 aa, Artificial
  Nanobody sequence
EVQLVESGGGLVQAGGSLRLSCAASGRAFSSYAMGWFRQAPGKERDFVAAITSSGSTNYADSVKGRFTISRDNAKNTVYLQMNSLKPEDTAVYYCAAKYYSYYAYDYWGQGTQVTVSS

SEQ ID NO: 2239 - protein, 124 aa, Artificial
  Nanobody sequence
EVQLVESGGGLVQAGGSLRLSCAASGGTFSVYHMAWFRQAPGKEREFVAAIRSSGGLFYALSVSGRFTISRDNAKDTMYLQMNVLKPEDTAVYYCAASPVYYIDYSSQYKYGYWGQGTQVTVSS

SEQ ID NO: 2240 - protein, 124 aa, Artificial
  Nanobody sequence
EVQLVESGGGLVQAGGSLRLSCAASGGAFGVYHMGWFRQAPGKEREFVAAIRSGGTTLYEDSVKGRFTISRDNAKNTVYLRMNSLKPEDTAVYYCATQIYYRTNYYSQNAYDYWGQGTQVTVSS

SEQ ID NO: 2241 - protein, 124 aa, Artificial
  Nanobody sequence
EVQLVESGGGLVQAGGSLRLSCAASGGTFGVYHMGWFRQAPGKEREFVAVIRSGGTTLYADSVKGRFTISRDDAKNTVYLQMNSLKPEDTAVYLCAAQIYYRTNYYSQNNYDYWGQGTQVTVSS

SEQ ID NO: 2242 - protein, 124 aa, Artificial
  Nanobody sequence
EVQLVESGGGLVQAGGSLELSCAASGGAFGVYHMGWFRQAPGKEREFVAAIRSGGTTLYEDSVKGRVTISRDDAKNTVYLRMNSLKPEDTAVYYCAAQIYYRTNYYSQNVYDYWGQGTQVTVSS

SEQ ID NO: 2243 - protein, 124 aa, Artificial
  Nanobody sequence
EVQLVESGGGLVQAGGSLRLSCAASGGTFGVYTMAWFRQAPGKEREFVAAIRSGATTLYEDSVKGRFTISRDDAKNTVYLRMNSLKPEDTAVYYCAAQIYYRTNYYSQNEYDYWGQGTQVTVSS

SEQ ID NO: 2244 - protein, 124 aa, Artificial
  Nanobody sequence
EVQLVESGGGLVQAGGSLRLSCAASGGTFGVYHMGWFRQAPGTEREFVAVIRSGGTTLYEDSVKGRFTISRDNAKNTVYLRMNSLKPEDTAVYYCAAQIYYRTNYSSQSNYDYWGQGTQVTVSS

SEQ ID NO: 2245 - protein, 124 aa, Artificial
  Nanobody sequence
EVQLVESGGGLVQAGGSLKLSCAVSGRTIVPYTMAWFRQAPGKEREFVAVTRSGGTTFYADSAKGRFTIARDDAKNTVYLQMNSLKPEDTAVYYCALATAYRTNYSSRDKYDYWGQGTQVTVSS

SEQ ID NO: 2246 - protein, 122 aa, Artificial
  Nanobody sequence
EVQLVESGGGLVQPGGSLRLSCAASGFTFSSYAMSWVRQAPGKGLEWVSAINSGGGSTSYADSVKGRFTISRDNAKNTLYLQMNSLKPEDTAVYYCAKYLSFYSDYEVYDYWGQGTQVTVSS

SEQ ID NO: 2247 - protein, 120 aa, Artificial
  Nanobody sequence
EVQLVESGGGLVQAGGSLRLSCAASGGTFSSGVMAWFRQSPGEEREFLALITRNGETKKTADSVKGRFTISRDNAKNGVSLQMDSLKAEDTAVYYCASDPTYGSGRWTYWGQGTQVTVSS

SEQ ID NO: 2248 - protein, 128 aa, Artificial
  Nanobody sequence
EVQLVESGGGLVQAGGSLRLSCAASRHTFSGYAMGWFRQAPGKEREFVAAIRWSGGITYYADSVKGRFTISSDNAKNTVYLQMNSLKPEDTALYYCARSVTYYSGSHAYTQEGGYARWGQGTQVTVSS

SEQ ID NO: 2249 - protein, 126 aa, Artificial
  Nanobody sequence
EVQLVESGGGLVQTGGSLRLSCAASGRAFSTYGMGWFRQAPGKAREFVAAISRSGTGTYYAGSMKGRFTISRDDAKNTVYLQMNSLKPEDTAVYYCAARQPYASGSHYSSTQYTYWGQGTQVTVSS

SEQ ID NO: 2250 - protein, 119 aa, Artificial
  Nanobody sequence
EVQLVESGGGLVQAGGSLRLSCAASGRSFNDYTMGWFRQTPGKEREFVARVWWNGGSAYYADSVKGRFTISIDNAKNTVYLQMNNLTPEDTAVYYCAALYRGRSVYDDWGQGTQVTVSS

SEQ ID NO: 2251 - protein, 127 aa, Artificial
  Nanobody sequence
EVQLVESGGGLVRAGTSLRLSCADSARTFSSAAMGWFRQAPGKEREFVSAISPIGSSKYYADSVKGRFTISRDNAKNTVYLQMDSLKPEDTAVYYCAASSYGSTYYSQGRAYYYDYWGQGTQVTVSS

SEQ ID NO: 2252 - protein, 124 aa, Artificial
  Nanobody sequence
EVQLVESGGGLVQPGGSLRLSCTVFGRTFSGDVIGWFRQAPGKEREFVAAISTSGGGTDSADSVKGRFTISKENAKNTVYLQMTILKPEDTAVYYCASSPYGPLYRSTHYYDYWGQGTQVTVSS

SEQ ID NO: 2253 - protein, 125 aa, Artificial
  Nanobody sequence
EVQLVESGGGLVQAGGSLGLSCAASGRTVSTMGWFRQAPGKEREFVTAITWSGDSTNFADSVKGRFTISRDSAKDTVYLQMNNLKPEDTAVYYCAATTYYSGSYISTLSTSYNYWGQGTQVTVSS

SEQ ID NO: 2254 - protein, 111 aa, Artificial
  Nanobody sequence
EVQLVESGGGLVQAGGSLRLSCVASGRTLSTTGVGWFRQAPGKGRESVATIFVGGTTYYSDSVKGRFTISRDNAKNAVNLQMSNLKPEDTALHYCTIGSYRGQGTQVTVSS

SEQ ID NO: 2255 - protein, 111 aa, Artificial
  Nanobody sequence
EVQLVESGGGLVQAGGSLRLSCVASGRTLSTTGVGWFRQAPGKERESVATIFVGGTTYYSDSVKGRFTISRDNARNAVNPQMNNLKPEDTAVYYCTIGSYRGQGTQVTVSS

SEQ ID NO: 2256 - protein, 127 aa, Artificial
  Nanobody sequence
EVQLVESGGGLVQAGGSLRLSCAASGRTFSRDVMGWFRQAPGKEREFVAAKTWSGASTYYADSVRGRFTISRDNAKNAVYLQMNSLKPEDTAVYYCAARDSSTLDSTYYVGGSYNYWGRGTQVTVSS

SEQ ID NO: 2257 - protein, 111 aa, Artificial
  Nanobody sequence
EVQLVESGGGLVQAGGSLRLSCVASGRTLSTTGVGWFRQAPGKERESVATIFVGGTTYYSDSVKGRFTISRDNAKNAVNLQMSNLKPEDTALYYCTIGSYRGQGTQVTVSS

SEQ ID NO: 2258 - protein, 125 aa, Artificial
  Nanobody sequence
EVQLVESGGGLVQAGGSLRLSCVRSGGYFGSYHIGWFRQAPGNEREFVAAITWNGASTSYADSVKGRFTISRSIAENTVYLQMNKVKPEDTAVYYCAARMYGSDWLPRPEDFDSWGQGTQVTVSS

SEQ ID NO: 2259 - protein, 120 aa, Artificial
  Nanobody sequence
EVQLVESGGGLVQPGGSLRLSCAASGSIFSINAMGWYRPAPGKQRELVARITSTGSTNYADSVKGRFTISRDNAKNTVYLQMNSLKPEDTAVYYCNADVSPSYGSRWYGWGQGTQVTVSS

SEQ ID NO: 2260 - protein, 127 aa, Artificial
  Nanobody sequence
EMQLVESGGGLVQAGGSLRLSCATSERTFSTYTMAWFRQAPGKEREFVVAIKSSDNSTSYRDSVKGRFTISRDNAKSTMYLQMNSLKPEDTAVYYCAARREYSTIYTARYPGEYVYWGQGTQVTVSS

SEQ ID NO: 2261 - protein, 116 aa, Artificial
  Nanobody sequence
EVQLVESGGGLVQPGGSLRLSCAASRSIFSPNVVGWYRQAPGKQRELVAAVTSGGITNYADSVKGRFTISRDNAKNTLYLQMNSLKAEDTAVYYCNARERGIYDSWGQGTQVTVSS

SEQ ID NO: 2262 - protein, 125 aa, Artificial
  Nanobody sequence
EVQLVESGGGLVQAGGSLRLSCAASGGTFSRYKMGWFRQAPGKEREFVAASRWSGGIKYHADSVKGRFTISRDDAKNSIYLQMNTLKPEDTAVYYCAADDYLGGDNWYLGPYDSWGQGTQVTVSS

SEQ ID NO: 2263 - protein, 124 aa, Artificial
  Nanobody sequence
EVQLVESGGGLVQAGGSLRLSCAVSGFLFDSYAMGWFRQAPGKEREFVAAIRWSGSATDYSDSVKGRFTISRDNAKNTVYLQMNSLIPEDTAVYYCAARKTYRSLTYYGEYDSWGQGTQVTVSS

SEQ ID NO: 2264 - protein, 125 aa, Artificial
  Nanobody sequence
EVQLVESGGGLVQPGGSLRLSCAASRSIRSVSVMGWYRLAPGNQRELVATITADGITNYADSVKGRFTVSRDNGRNTVYLQMNSLKPEDTAVYYCNVDRLLYYSSGYYQTSVDVWGQGTQVTVSS

SEQ ID NO: 2265 - protein, 125 aa, Artificial
  Nanobody sequence
EVQLVESGGALVQPGGSLRLSCAASGSIRSINTMGWYRQAPGNQREFVAAVTEGGTTSYAASVKGRFTISRDKAKNTVLLQMDSLKPEDTAVYYCNADRFLYYSAGRYDTGSDIWGQGTQVTVSS

SEQ ID NO: 2266 - protein, 125 aa, Artificial
  Nanobody sequence
EVQLVESGGALVQPGGSLRLSCAASDSIRSINIMGWYRQAPGKQREFVAAVTEDGSINYAESVKGRFTISRDKAKNALYLQMNSLKPEDMAVYYCNADRVLYYSDSRYYTGSNYWGQGTQVTVSS

SEQ ID NO: 2267 - protein, 127 aa, Artificial
  Nanobody sequence
EVQLVESGGGLVQPGGSLRLSCAASGSSASINTMGWYRQAPGEQRELVAEITEGGIINYTDSVKGRFTISRDNAKNTVYLEMNNLKPEDTAVYYCNADRALYRNYSDGRYYTGYDYWGQGTQVTVSS

SEQ ID NO: 2268 - protein, 115 aa, Artificial
  Nanobody sequence
EVQLVESGGGLVQPGGSLRLSCAASRNIFDFNDMGWYRQGPGKEREFVALINVGGVAKYEDSVKGRFTISRDNAENTVYLQMNNLKPEDMAVYYCNARILSRNYWGQGNQVTVSS

SEQ ID NO: 2269 - protein, 127 aa, Artificial
  Nanobody sequence
EVQLVESGGGLVQAGGSLRLSCAASGGTFSGRGMGWFRQAPGKEREFVAAVSWSGGNTYYADSVKGRFTISRDNAKSTVYLQMDSLKPEDTAVYYCAASRRFYSGLYYYTDDAYEYWGQGTQVTVSS

SEQ ID NO: 2270 - protein, 127 aa, Artificial
  Nanobody sequence
EVQLVESGGGLVQAGGSLSLSCAASGGTFNGRAVGWFRQAPGEEREFVTGISWSGGSTDYADSVKGRFTISRDNSKNTVSLQMNSLKPEDTAVYYCAASRRFYSGLVYYSVDAYENWGQGTQVTVSS

SEQ ID NO: 2271 - protein, 130 aa, Artificial
  Nanobody sequence
EVQLVESGGGLVQAGGSLRLSCAISGRTLSGRAMGWFRQAPGKEREFREFVAATSWSGGSKYVADSVTGRFTIFRDNAENTAYLQMNSLNPEDTAVYYCAVTKRYYSIKYYSTVEDYEYWGQGTQVTVSS

SEQ ID NO: 2272 - protein, 128 aa, Artificial
  Nanobody sequence
EVQLVESGGGLVQAGGSLRLSCAVSGRTFNNDHMGWFRQAPGTERELVAATGRRGGPTYYADSVKGRFTISRDNAESTVYLQMNSLKAEDTAVYYCAANRYYCSTYGCLSTPRQYDYWGQGTQVTVSS

SEQ ID NO: 2273 - protein, 120 aa, Artificial
  Nanobody sequence
EVQLVESGGGLVRPGGSLRLSCATSGSDIGINAMGWYRQAPGNQRELVATITGSTGTTYADSVKGRFAISRDGAKNTVYLQMDSLKPEDTAVYYCNLRVYTGTYGGRNYWGQGTQVTVSS

SEQ ID NO: 2274 - protein, 118 aa, Artificial
  Nanobody sequence
EVQLVESGGGLVQAGGSLRLSCAASGRALINYAMGWFRQAPGKEREFVSAINWSGSHTDYGDSVKGRFAISRDNAKNTVYLQMHSLKPEDTAVYHCATGYSLPAFDSWGPGTQVTVSS

SEQ ID NO: 2275 - protein, 118 aa, Artificial
  Nanobody sequence
EVQLVESGGGVVQAGGSLRLSCAPSGRTFSSYVMGWVRQAPGKAREFVAGITRNSGRTRYADSVKGRFTISRDNADNTVTLQMNSLKPEDTAVYYCAGGIDLYTFHYFGQGTQVTVSS

SEQ ID NO: 2276 - protein, 118 aa, Artificial
  Nanobody sequence
EVQLVESGGGLVQAGGSLRLSCAPSGRTFSSYVMGWVRQAPGKAREFVAGITRNSIRTRYADSVKGRFTISRDNADNTVTLQMNSLKPEDTAVYYCAGGIDLYTFDYFGQGTQVTVSS

SEQ ID NO: 2277 - protein, 126 aa, Artificial
  Nanobody sequence
EVQLVESGGGLVQAGGSLRLSCAASGRPVNNYIMGWFRQALGQGREFVAAINRNGATAAYADSVKGRFTISRDNAEDLLYLQMNLLKPEDTAVYYCAANSDSGFDSYSVWAAYEYWGQGTQVTVSS

SEQ ID NO: 2278 - protein, 121 aa, Artificial
  Nanobody sequence
EVQLVESGGGLVQAGGSLRLSCAASGRTFSAYAMGWFRQAPGKERESVATIRWTGGSSSTSYADSVKGRFTISKNTAENTVYLQMNSLKPEDTAVYYCAVLLTVWDTYKYWGQGTQVTVSS

SEQ ID NO: 2279 - protein, 123 aa, Artificial
  Nanobody sequence
EVQLVESGGGLVQAGGSLRLSCAASGRTYNMAWFRQAPGKEREFVAAMNWSGGSTKYAESVKGRFTISRANDNNPLYLQMNTLKPEDTAVYYCAATNRWYTGVYDLPSRYEYWGQGTQVTVSS

SEQ ID NO: 2280 - protein, 123 aa, Artificial
  Nanobody sequence
EVQLVESGGGLVQAGGSLRLSCTASGQTFNMGWFRQAPGKEREFVAAISWSQYNTKYADSVKGRFTISRDNAINSLYLQMDTLKPEDTAVYYCAATNRWFSAVYDLPSRYTYWGQGTQVTVSS

SEQ ID NO: 2281 - protein, 114 aa, Artificial
  Nanobody sequence
EVQLVESGGAFVQPGGSLRLSCAASGSDVWFNVMGWYRQGPGQQLELVASITYGGNINYGDPVKGRFSISRDNALKTVYLQMNSLKPEDTAVYYCYADLPSRLWGQGTQVTVSS

SEQ ID NO: 2282 - protein, 123 aa, Artificial
  Nanobody sequence
EVQLVESGGGLVQAGGSLRLSCTASGRAFNMGWFRQAPGKEREFVAGVNWGGGSTKVADSVKERFTISRDYDNSPVYLQMNTLKPEDTAVYYCAATSRWYSAVYDLPTRYDYWGQGTQVTVSS

SEQ ID NO: 2283 - protein, 124 aa, Artificial
  Nanobody sequence
EVQLVESGGGLVQAGGSLRLSCQLSGGTVSDLHMGWFRQAPGKEREFVGFTRWPSITYIAEHVKGRFTISRDNAKNTVYLQMNSLEREDTAVYYCAADRSYSIDYRHPDSYSYWGQGTQVTVSS

SEQ ID NO: 2284 - protein, 123 aa, Artificial
  Nanobody sequence
EVQLVESGGGLVQAGGSLRLSCAASGSIFRVNHMGWYRQAPGKQREFVAAITSDHITWYADAVKGRFTISRDNAKNTVTLQMNSLRPEDTAVYYCAADPLLFYGVGSADVDYWGQGTQVTVSS

SEQ ID NO: 2285 - protein, 117 aa, Artificial
  Nanobody sequence
EVQLVESGGGLVQPGGSLRLSCAGSGNIVRDNTMAWYRQAPGNQRDLVATINVGGGTYYAGPVKGRFTISRDNAKNSVYLQMNSLKPEDTSVYYCNVISGLVQRDYWGQGTQVTVSS

SEQ ID NO: 2286 - protein, 124 aa, Artificial
  Nanobody sequence
EVQLVESGGGLVQAGGSLRLSCAASGRTFSMYLMGWFRQAPGKEREFVSTINRRGGNTYYADSVKGRFTISRDNARNTVYLQMNSLKPEDTAVYYCAAGGHLLGYDVQWEPDYWGQGTQVTVSS

SEQ ID NO: 2287 - protein, 126 aa, Artificial
  Nanobody sequence
EVQLVESGGGLVQAGGSLRLSCAASGRTFERYAMGWFRQAPGKEREFVATISWSGGRDTVYADSVKGRFTISRDNAKNTVYLQMNSLKPEDTAVYYCAAHKRTYELGAHSTDFGSWGQGTQVTVSS

SEQ ID NO: 2288 - protein, 126 aa, Artificial
  Nanobody sequence
EVQLVESGGDLVQPGESLRLSCAVSGVTVDYSGIGWFRQAPEKEREAVSCIESGDGTTTYVDSVKGRFTISRDNAKNAVYLQMNSLKPEDTGVYYCATAVFVDSGDFSVCRGVGYWGKGTQVTVSS

SEQ ID NO: 2289 - protein, 121 aa, Artificial
  Nanobody sequence
EVQLVESGGGLVQAGASLRLSCAASGRTFSRYDIGWFRQAPGKGREFVAAINWSGGTTSFGDSVKGRFTISRDNAKNTVYLQMNSLKPEDTAVYYCAALRSWPRGVDSGSWGQGTQVTVSS

SEQ ID NO: 2290 - protein, 123 aa, Artificial
  Nanobody sequence
EVQLVESGGGLVQTGGSLRLSCAASGRTFSGSRMGWFRQAPGKEREFVAAIRWSGGITWYAESVKSRFTISRDNTKNTIDLQINSLKPEDTAVYYCAADVIYKNIGSGSFDYWGQGTQVTVSS

SEQ ID NO: 2291 - protein, 123 aa, Artificial
  Nanobody sequence
EVQLVESGGGLVQAGGSLRLSCAASGRTFSGSRMGWLRQAPGKEREFVAAVRWSGGITWYAESVKGRFTISRDNTKNTIDLQINSLKPEDTAVYYCAADVIYKNIGSGSFDYWGQGTQVTVSS

SEQ ID NO: 2292 - protein, 123 aa, Artificial
  Nanobody sequence
EVQLVESGGGLVQAGGSLRLSCAVSGLTFSSYAMGWFRQAPGKVREFVATISRSGGRTSYADSVKGRFIVSRDNAKNTADLQMNDLKPEDTAVYYCGASKWYGGFGDTDIEYWGQGTQVTVSS

SEQ ID NO: 2293 - protein, 123 aa, Artificial
  Nanobody sequence
EVQLVESGGGLVQAGGSLRLSCAVSGLTFSTYAMGWFRQAPGKVREFVATISRSGGRTSYADSVKGRFIVSRDNAKNTADLQMNELKPEDTAVYYCGASKWYGGFGDTDIEYWGQGTQVTVSS

SEQ ID NO: 2294 - protein, 113 aa, Artificial
  Nanobody sequence
EVQLVESGGGLVQPGGSLRLSCAASGITFRFKAMGWFRQGPGKRRELVARIAGGSTNYADSVKGRFTISRDDAKNTVFLQMNSLKPEDTAVYYCNVDGPFGNWGQGTQVTVSS

SEQ ID NO: 2295 - protein, 125 aa, Artificial
  Nanobody sequence
EVQLVESGGGLVQAGGSLRLSCTASGGTFGSYALGWFRQSPGKERESVAAIDWDGSRTQYADSVKGRFTISRENVKDTMYLQMNSLQAEDTGVYYCVRSRHSGNTLSFSLKYDYWGQGTQVTVSS

SEQ ID NO: 2296 - protein, 125 aa, Artificial
  Nanobody sequence
EVQLVESGGGLVQAGGSLRLSCAASEPTFSSVAMGWFRQGPGKEREFAATITWSGDSTYVTDSVKGRFTISRDNARNTAYLQMDSLRPEDTAVYSCAARRWSGTLSLFDNEYYYWGQGTQVTVSS

SEQ ID NO: 2297 - protein, 121 aa, Artificial
  Nanobody sequence
EVQLVESGGGLVQAGGSLRLSCVASGRTSSYYHMAWFRQAPGKEREFIAAINLSSGSTYYPDSVKGRFTISRGNAKNTVNLQMNSLKPEDTAVYYCAADNYRDSYLEYDYWGQGTQVTVSS

SEQ ID NO: 2298 - protein, 125 aa, Artificial
  Nanobody sequence
EVQLVESGGGLVQAGGSLSLSCAASGRTFSNYRMAWFRQAPRKEREFVAAISRSGESTYFADSMKGRFTISRDNTESTGYLQMNNLKPEDTAVYYCAASWDHGDYVDGGFFYDYWGQGTQVTVSS

SEQ ID NO: 2299 - protein, 124 aa, Artificial
  Nanobody sequence
EVQLVESGGGLVQAGGSLRLSCAASGRTFSRYAMHWFRQAPGSERDFVAGISWDGGSTFYANSVKGRFTISRDNAKNMVYLQMNSLKPEDTAVYYCAAAGSAGPPSIDRQYDYWGQGTQVTVSS

SEQ ID NO: 2300 - protein, 118 aa, Artificial
  Nanobody sequence
EVQLVESGGGLVQPGGSLRLSCAASGSSLSFNAMGWSREAPGKRRELVARIISDDSTLYADSVKGRFTISRDYAKNTAYLQMNSLKPEDTAVYYCVADVRDSIWRSYWGQGTQVTVSS

SEQ ID NO: 2301 - protein, 120 aa, Artificial
  Nanobody sequence
EVQLVESGGGLVQAGGSLRLSCAASGRALSNYAMRWFRQAPGKEREFVATINWSGSHTDYADSVKGRFTISRDNAENTVYLQMNSLTPEDTAVYYCASGWGATQAQSGFWGQGTQVTVSS

SEQ ID NO: 2302 - protein, 120 aa, Artificial
  Nanobody sequence
EVQLVESGGGLVQAGGSLRLSCAASGRALISFAMRWFRQAPGKEREFVAAINWSGTHTDYADSVKGRFTISRDNAENTVYLLMNSLIPEDTAVYYCATGWGATQAQHGFWGQGTQVTVSS

SEQ ID NO: 2303 - protein, 120 aa, Artificial
  Nanobody sequence
EVQLVESGGGLVQAGGSLRLSCAASGRTSSGYGMGWFRQAPGKEREFVAAVGWYGSTYFADSVKGRFTIYRDNAQNTMYLQMNSLKPEDTAVYYCAASSSLATISQPSSWGQGTQVTVSS

SEQ ID NO: 2304 - protein, 118 aa, Artificial
  Nanobody sequence
EVQLVESGGGLVQPGGSLRLSCAHSGRAFSLRTMGWYRQAPGNQRELVALISAGDSTYYPDSVKGRFTVSRDNAKNTVYLQMNSLKPEDTAVYYCNAKAVTSRDHEYWGQGTQVTVSS

SEQ ID NO: 2305 - protein, 128 aa, Artificial
  Nanobody sequence
EVQLVESGGGLVQAGGSLRLSCAASGRTFSRYAMGWFRQAPGKEREFVAAISWTGGSSYYGDSVKGRSTISRENAENTVYLQMNSLKPEDTAVYYCAANSDEFYSGTLKLQSRMVEYWGQGTQVTVSS

SEQ ID NO: 2306 - protein, 118 aa, Artificial
  Nanobody sequence
EVQLVESGGGLVQAGGSLRLSCAASGGIFSSHAISWFRQAPGKAREFVAAINWSGSHRDYADSAKGRFTISRDNAKKTAYLQMNSLRPEDTAVYYCVGGWKTDEYVKWGQGTQVTVSS

SEQ ID NO: 2307 - protein, 120 aa, Artificial
  Nanobody sequence
EVQLVESGGGLVQAGGSLRLSCAASGRIFSNYAWSWFRQAPGKERGFVAAINWSGGYTDYADSVKGRFTISRDNTKNTVYLQMNSLKPEDTAVYYCRPGWVTPSYEYGNWGQGTQVTVSS

SEQ ID NO: 2308 - protein, 128 aa, Artificial
  Nanobody sequence
EVQLVESGGGLVQAGGSLRLSCAASGRTFISSPMGWFRQAPGKEREVVAATTRSGGLPYYSDSVKGRFTISRDNAKNTVDLQMSSLKPEDTAAYYCAADQKYGMSYSRLWLVSEYEYWGQGTQVTVSS

SEQ ID NO: 2309 - protein, 115 aa, Artificial
  Nanobody sequence
EVQLVESGGGLVQPGGSLRLSCAASGSIDSIHVVGWYRKAPGKQREVVAYIGTAGATHYADSVKGRFTISRDNAENLVYLQMNNLKPEDTAVYYCSAGWGDSAYWGQGTQVTVSS

SEQ ID NO: 2310 - protein, 123 aa, Artificial
  Nanobody sequence
EVQLVESGGGLVQSGGSLRLSCVASGTIVSINATSWYRQAPGNQRELVATIIGDGRTHYADSVKDRFTISRDAAANLVYLQMNSLKPSDTAIYSCNANGIESYGWGNRHFNYWTVGTQVTVSS

SEQ ID NO: 2311 - protein, 119 aa, Artificial
  Nanobody sequence
EVQLVESGGGMVQAGGSLRLSCAASGLTLSNYGMGWFRQAPGKEREFVSSINWSGTHTYDADFVKGRFIISRDNAKNTVYLQINSLKPEDTAVYYCAAGGWGTGRYNYWGQGTQVTVSS

SEQ ID NO: 2312 - protein, 122 aa, Artificial
  Nanobody sequence
EVQLVESGGGLVQAGGSLRLSCAASGRTFISNYAMGWFRQAPGKEREFVATINWSGSHSDYADSVKGRFTISRDNAKNTVYLQMNNLKSEDTAVYYCAPGWGTAPLSTSVYWGQGTQVTVSS

SEQ ID NO: 2313 - protein, 123 aa, Artificial
  Nanobody sequence
EVQLVESGGGLVQAGGSLRLSCVASGRTFSGYSVGWFRQSPGKEREFVGGINWSGRTYYVDSVKGRFTFSRDNAKNTVYLQMNSLKPEDTAIYLCAVDRFNTIANLPGEYDYWGQGTQVTVSS

SEQ ID NO: 2314 - protein, 135 aa, Artificial
  Nanobody sequence
EVQLVESGGGLVQDGGSLRLSCAASGQLANFASYAMGWFRQAPGKAREFVAAIRGSGGSTYIADPARSTYYADFVKGRFTISRDNAKNTVYLQMNSLKPEDTAVYYCACETFNSISNLPGEYDYWGQGTQVTVSS

SEQ ID NO: 2315 - protein, 124 aa, Artificial
  Nanobody sequence
KVQLVESGGGLVQAGGSLRLSCAASGRTFSNYSVGWFRQAPGKEREFVAALSKDGARTYYAASVKGRFTIYRDNAKNVVYLQMSVLNGEDTAVYYCAADHFTFMSNLPSEYDYWGQGTQVTVSS

SEQ ID NO: 2316 - protein, 124 aa, Artificial
  Nanobody sequence
EVQLVESGGGLVQAGGSLTLSCVISGLTLESHAMGWFRQAPGEEREFVATIRWSGSATFYSDSVKGRFTISRDNAKNTVYLQMNSLKPEDTAVYYCAARKIYRSLSYYGDYDSWGQGTQVTVSS

SEQ ID NO: 2317 - protein, 123 aa, Artificial
  Nanobody sequence
EVQLVESGGGLVQPGGSLRLSCAASGRTFSDLALGWFRRAPGKEREHVAAISSSGVTTIYADSVRGRFTISRDEAKNTVYLEMNSLKTDDTAVYYCAARLTMATPNQSQYYYWGQGTQVTVSS

SEQ ID NO: 2318 - protein, 114 aa, Artificial
  Nanobody sequence
EVQLVESGGGSVQPGGSLRLSCVASGSISSTNAMGWHRQVSGKERELVAIVTDGFTNYADFAKGRFTISRDNAKTTVYLQMNSLQPEDTARYYCRYSGIGTDNWGQGIEVTVSS

SEQ ID NO: 2319 - protein, 114 aa, Artificial
  Nanobody sequence
EVQLVESGGGSVQPGGSLRLSCVASGSISSVNAMGWHRQVPGKQRELVAIVTDGFTNYADFAKGRFTISRDNAKTTVYLQMNSLQPEDTARYYCRYSGIGTDNWGQGIEVTVSS

SEQ ID NO: 2320 - protein, 122 aa, Artificial
  Nanobody sequence
EVQLVESGGGLVQPGGSLRLSCAASGNIKSIDVMGWHRQAPGKERELVSDISFGGNTNYANSVKGRFTISRDNAKNTVYLQMNSLKPEDTAVYYCYADILYKTDIYYRNDFWGQGTQVTVSS

SEQ ID NO: 2321 - protein, 131 aa, Artificial
  Nanobody sequence
EVQLVESGGGLVQAGGSLRLSCAASGFSFADYAIGWFRQAPGKEREGVSCIANSEGTKYYADSAQGRLPISSDNAKKTVYLQMDSLKPEDTAVYYCAALPYTICPVVVKKGAVYYGVDDYWGKGTQVTVSS

SEQ ID NO: 2322 - protein, 120 aa, Artificial
  Nanobody sequence
EVQLVESGGGLVQPGGSLRLSCAASGFPFGMYGMRWVRQAPGKGPERVSSINSDGDTTYYADSVKGRFTISRDNDENMLYLQMNSLKPEDTAVYYCATGFSDRSFAVTHKGQGTQVTVSS

SEQ ID NO: 2323 - protein, 124 aa, Artificial
  Nanobody sequence
EVQLVESGGGLEQAGGSLRLSCAASGLTFRSAAMGWFRQGPGKEREFVAAISRDGAATYYTDSVKGRFTISRDNAKNTVFLQMNSLKPEDTAIYYCAADFRLARLRVADDYDYWGQGTQVTVSS

SEQ ID NO: 2324 - protein, 130 aa, Artificial
  Nanobody sequence
EVQLVESGGGLVQAGGSLRLSCAASGFSLDDRAIAWFRQAPGKAREGVSCITPHHGGIIFTRESVKGRFATSSDSAKNTVYLQMHSLKPEDTAVYYCATLRTDYSINWANCQRDSLYGYWGQGTQVTVSS

SEQ ID NO: 2325 - protein, 119 aa, Artificial
  Nanobody sequence
EMQLVESGGGLVQPGGSLRLSCAASGNIPPINAMAWYRQAPGNERELVAAVTSGGGTNYATSVKGRFIISRDDSKNTVDLQMNSLKPEDTAVYYCNLGGWTRTHPFDYWGQGTQVTVSS

SEQ ID NO: 2326 - protein, 249 aa, Artificial
  Nanobody sequence
EVQLVESGGGLVQPGGSLRLSCAASGFIFDDYAMSWVRQAPGKGLEWVSAINWSGSHRNYADSVKGRFTISRDNAKKTVYLQMNSLQSEDTAVYYCGTGWQSTTKNQGYWGQGTQVTVSSGGGGSGGGSEVQLVESGGGLVQPGGSLRLSCAASGFIFDDYAMSWVRQAPGKGLEWVSAINWSGSHRNYADSVKGRFTISRDNAKKTVYLQMNSLQSEDTAVYYCGTGWQSTTKNQGYWGQGTQVTVSS

SEQ ID NO: 2327 - protein, 257 aa, Artificial
  Nanobody sequence
EVQLVESGGGLVQPGGSLRLSCATSGFTFDDYAMTWVRQAPGKGLEWVSSINWSGTHTDYTDSVKGRFTISRNNANNTLYLQMNSLKSEDTAVYYCAKNWGDAGTTWFEKSGSAGQGTQVTVSSGGGGSGGGSEVQLVESGGGLVQPGGSLRLSCATSGFTFDDYAMTWVRQAPGKGLEWVSSINWSGTHTDYTDSVKGRFTISRNNANNTLYLQMNSLKSEDTAVYYCAKNWGDAGTTWFEKSGSAGQGTQVTVSS

SEQ ID NO: 2328 - protein, 245 aa, Artificial
  Nanobody sequence
EVQLVESGGGLVQPGGSLRLSCVASGFSLDDYGMTWVRQAPGKGLEWVSSINWSGTHTDYADSVKGRFTISRDNAKNTLFLQMNSLRSEDTAVYYCNQGWKIVPTDRTGHGTQVTVSSGGGGSGGGSEVQLVESGGGLVQPGGSLRLSCVASGFSLDDYGMTWVRQAPGKGLEWVSSINWSGTHTDYADSVKGRFTISRDNAKNTLFLQMNSLRSEDTAVYYCNQGWKIVPTDRTGHGTQVTVSS

SEQ ID NO: 2329 - protein, 257 aa, Artificial
  Nanobody sequence
EVQLVESGGSLVQPGGSLRLSCAASGFTFDDYAMSWVRQVPGKGLEWVSSINWSGTHTDYADSVKGRFTISRNNANNTLYLQMNSLKSEDTAVYYCAKNWRDAGTTWFEKSGSAGQGTQVTVSSGGGGSGGGSEVQLVESGGSLVQPGGSLRLSCAASGFTFDDYAMSWVRQVPGKGLEWVSSINWSGTHTDYADSVKGRFTISRNNANNTLYLQMNSLKSEDTAVYYCAKNWRDAGTTWFEKSGSAGQGTQVTVSS

SEQ ID NO: 2330 - protein, 245 aa, Artificial
  Nanobody sequence
EVQLVESGGGLVQAGGSLRLSCAASGITFSINTMGWYRQAPGKQRELVALISSIGDTYYADSVKGRFTISRDNAKNTVYLQMNSLKPEDTAVYYCKRFRTAAQGTDYWGQGTQVTVSSGGGGSGGGSEVQLVESGGGLVQAGGSLRLSCAASGITFSINTMGWYRQAPGKQRELVALISSIGDTYYADSVKGRFTISRDNAKNTVYLQMNSLKPEDTAVYYCKRFRTAAQGTDYWGQGTQVTVSS

SEQ ID NO: 2331 - protein, 242 aa, Artificial
  Nanobody sequence
EVQLVESGGGLVQPGGSLRLSCVASGFSLDDYGMTWVRQAPGKGLEWVSSINWSGTHTDYADSVKGRFTISRDNAKNTLFLQMNSLRSEDTAVYYCNQGWKIVPTDRTGHGTQVTVSSGGGGSGGGSEVQLVESGGGLVQPGNSLRLSCAASGFTFRSFGMSWVRQAPGKEPEWVSSISGSGSDTLYADSVKGRFTISRDNAKTTLYLQMNSLKPEDTAVYYCTIGGSLSRSSQGTQVTVSS

SEQ ID NO: 2332 - protein, 244 aa, Artificial
  Nanobody sequence
EVQLVESGGGLVQPGGSLRLSCAASGFIFDDYAMSWVRQAPGKGLEWVSAINWSGSHRNYADSVKGRFTISRDNAKKTVYLQMNSLQSEDTAVYYCGTGWQSTTKNQGYWGQGTQVTVSSGGGGSGGGSEVQLVESGGGLVQPGNSLRLSCAASGFTFRSFGMSWVRQAPGKEPEWVSSISGSGSDTLYADSVKGRFTISRDNAKTTLYLQMNSLKPEDTAVYYCTIGGSLSRSSQGTQVTVSS

SEQ ID NO: 2333 - protein, 248 aa, Artificial
  Nanobody sequence
EVQLVESGGGLVQPGGSLRLSCATSGFTFDDYAMTWVRQAPGKGLEWVSSINWSGTHTDYTDSVKGRFTISRNNANNTLYLQMNSLKSEDTAVYYCAKNWGDAGTTWFEKSGSAGQGTQVTVSSGGGGSGGGSEVQLVESGGGLVQPGNSLRLSCAASGFTFRSFGMSWVRQAPGKEPEWVSSISGSGSDTLYADSVKGRFTISRDNAKTTLYLQMNSLKPEDTAVYYCTIGGSLSRSSQGTQVTVSS

SEQ ID NO: 2334 - protein, 248 aa, Artificial
  Nanobody sequence
EVQLVESGGSLVQPGGSLRLSCAASGFTFDDYAMSWVRQVPGKGLEWVSSINWSGTHTDYADSVKGRFTISRNNANNTLYLQMNSLKSEDTAVYYCAKNWRDAGTTWFEKSGSAGQGTQVTVSSGGGGSGGGSEVQLVESGGGLVQPGNSLRLSCAASGFTFRSFGMSWVRQAPGKEPEWVSSISGSGSDTLYADSVKGRFTISRDNAKTTLYLQMNSLKPEDTAVYYCTIGGSLSRSSQGTQVTVSS

SEQ ID NO: 2335 - protein, 242 aa, Artificial
  Nanobody sequence
EVQLVESGGGLVQAGGSLRLSCAASGITFSINTMGWYRQAPGKQRELVALISSIGDTYYADSVKGRFTISRDNAKNTVYLQMNSLKPEDTAVYYCKRFRTAAQGTDYWGQGTQVTVSSGGGGSGGGSEVQLVESGGGLVQPGNSLRLSCAASGFTFRSFGMSWVRQAPGKEPEWVSSISGSGSDTLYADSVKGRFTISRDNAKTTLYLQMNSLKPEDTAVYYCTIGGSLSRSSQGTQVTVSS

SEQ ID NO: 2336 - protein, 272 aa, Artificial
  Nanobody sequence
EVQLVESGGGLVQAGGSLTLSCTASETTVRIRTMAWYRQPPGNQREWVATIGSNGFATYPDSVKGRFTISRDNAKNTVYLQMNSLKPEDTAVYYCRDINRDIWGQGSQVTVSSGGGGSGGGGSGGGGSGGGGSGGGGSGGGGSGGGGSEVQLVESGGSLVQPGGSLRLSCAASGFTFDDYAMSWVRQVPGKGLEWVSSINWSGTHTDYADSVKGRFTISRNNANNTLYLQMNSLKSEDTAVYYCAKNWRDAGTTWFEKSGSAGQGTQVTVSS

SEQ ID NO: 2337 - protein, 281 aa, Artificial
  Nanobody sequence
EVQLVESGGGLVQPGGSLRLSCAASGFTFDDYATSWVRQAPGKGPEWVSAINSGGGSTYYADSVKGRFTISRDNAKNTLYLQMNSLKPEDTAVYYCARPRGSSLYLLEYDYWGQGTQVTVSSGGGGSGGGGSGGGGSGGGGSGGGGSGGGGSGGGGSEVQLVESGGSLVQPGGSLRLSCAASGFTFDDYAMSWVRQVPGKGLEWVSSINWSGTHTDYADSVKGRFTISRNNANNTLYLQMNSLKSEDTAVYYCAKNWRDAGTTWFEKSGSAGQGTQVTVSS

SEQ ID NO: 2338 - protein, 272 aa, Artificial; identical to SEQ ID NO: 2336
  Nanobody sequence

SEQ ID NO: 2339 - protein, 274 aa, Artificial
  Nanobody sequence
EVQLVESGGGLVQAGGSLRLSCAASGIISSFRTLAWYRQAPGKQRDWVATISSAGGTAYADAVKGRFTISISRDNVEYTVDLQMDSLKPEDTAVYYCRDINGDYWGQGTQVTVSSGGGGSGGGGSGGGGSGGGGSGGGGSGGGGSGGGGSEVQLVESGGSLVQPGGSLRLSCAASGFTFDDYAMSWVRQVPGKGLEWVSSINWSGTHTDYADSVKGRFTISRNNANNTLYLQMNSLKSEDTAVYYCAKNWRDAGTTWFEKSGSAGQGTQVTVSS

SEQ ID NO: 2340 - protein, 272 aa, Artificial; identical to SEQ ID NO: 2336
  Nanobody sequence

SEQ ID NO: 2341 - protein, 272 aa, Artificial; identical to SEQ ID NO: 2336
  Nanobody sequence

SEQ ID NO: 2342 - protein, 278 aa, Artificial
  Nanobody sequence
KVQLVESGGGLVQPGGSLRLSCAASGSIFGFNDMAWYRQAPGKQRELVALISRVGVTSSADSVKGRFTISRVNAKDTVYLQMNSLKPEDTAVYYCYMDQRLDGSTLAYWGQGTQVTVSSGGGGSGGGGSGGGGSGGGGSGGGGSGGGGSGGGGSEVQLVESGGSLVQPGGSLRLSCAASGFTFDDYAMSWVRQVPGKGLEWVSSINWSGTHTDYADSVKGRFTISRNNANNTLYLQMNSLKSEDTAVYYCAKNWRDAGTTWFEKSGSAGQGTQVTVSS

SEQ ID NO: 2343 - protein, 285 aa, Artificial
  Nanobody sequence
EVQLVESGGGLVQAGGSLRLSCAASGRTFRSYPMGWFRQAPGKEREFVASITGSGGSTYYADSVKGRFTISRDNAKNTVYLQMNSLRPEDTAVYSCAAYIRPDTYLSRDYRKYDYWGQGTQVTVSSGGGGSGGGGSGGGGSGGGGSGGGGSGGGGSGGGGSEVQLVESGGSLVQPGGSLRLSCAASGFTFDDYAMSWVRQVPGKGLEWVSSINWSGTHTDYADSVKGRFTISRNNANNTLYLQMNSLKSEDTAVYYCAKNWRDAGTTWFEKSGSAGQGTQVTVSS

SEQ ID NO: 2344 - protein, 283 aa, Artificial
  Nanobody sequence
EVQLVESGGSLVQPGGSLRLSCAASGFTFDDYAMSWVRQVPGKGLEWVSSINWSGTHTDYADSVKGRFTISRNNANNTLYLQMNSLKSEDTAVYYCAKNWRDAGTTWFEKSGSAGQGTQVTVSSGGGGSGGGGSGGGGSGGGGSGGGGSGGGGSGGGGSEVQLVESGGSLVQPGGSLRLSCAASGFTFDDYAMSWVRQVPGKGLEWVSSINWSGTHTDYADSVKGRFTISRNNANNTLYLQMNSLKSEDTAVYYCAKNWRDAGTTWFEKSGSAGQGTQVTVSS

SEQ ID NO: 2345 - protein, 280 aa, Artificial
  Nanobody sequence
EVQLVESGGGLVQAGGSLRLSCAASGRTFRSYPMGWFRQAPGKEREFVASITGSGGSTYYADSVKGRFTISRDNAKNTVYLQMNSLRPEDTAVYSCAAYIRPDTYLSRDYRKYDYWGQGTQVTVSSGGGGSGGGGSGGGGSGGGGSGGGGSGGGGSGGGGSEVQLVESGGGLVQPGGSLRLSCAASGSIFGFNDMAWYRQAPGKQRELVALISRVGVTSSADSVKGRFTISRVNAKDTVYLQMNSLKPEDTAVYYCYMDQRLDGSTLAYWGQGTQVTVSS

SEQ ID NO: 2346 - protein, 272 aa, Artificial
  Nanobody sequence
EVQLVESGGGLVQAGGSLRLSCAASGITFSINTMGWYRQAPGKQRELVALISSIGDTYYADSVKGRFTISRDNAKNTVYLQMNSLKPEDTAVYYCKRFRTAAQGTDYWGQGTQVTVSSGGGGSGGGGSGGGGSGGGGSGGGGSGGGGSGGGGSEVQLVESGGGLVQPGGSLRLSCAASGSIFGFNDMAWYRQAPGKQRELVALISRVGVTSSADSVKGRFTISRVNAKDTVYLQMNSLKPEDTAVYYCYMDQRLDGSTLAYWGQGTQVTVSS

SEQ ID NO: 2347 - protein, 272 aa, Artificial
  Nanobody sequence
KVQLVESGGGLVQPGGSLRLSCAASGSIFGFNDMAWYRQAPGKQRELVALISRVGVTSSADSVKGRFTISRVNAKDTVYLQMNSLKPEDTAVYYCYMDQRLDGSTLAYWGQGTQVTVSSGGGGSGGGGSGGGGSGGGGSGGGGSGGGGSGGGGSEVQLVESGGGLVQAGGSLRLSCAASGITFSINTMGWYRQAPGKQRELVALISSIGDTYYADSVKGRFTISRDNAKNTVYLQMNSLKPEDTAVYYCKRFRTAAQGTDYWGQGTQVTVSS

SEQ ID NO: 2348 - protein, 278 aa, Artificial
  Nanobody sequence
EVQLVESGGSLVQPGGSLRLSCAASGFTFDDYAMSWVRQVPGKGLEWVSSINWSGTHTDYADSVKGRFTISRNNANNTLYLQMNSLKSEDTAVYYCAKNWRDAGTTWFEKSGSAGQGTQVTVSSGGGGSGGGGSGGGGSGGGGSGGGGSGGGGSGGGGSEVQLVESGGGLVQPGGSLRLSCAASGSIFGFNDMAWYRQAPGKQRELVALISRVGVTSSADSVKGRFTISRVNAKDTVYLQMNSLKPEDTAVYYCYMDQRLDGSTLAYWGQGTQVTVSS

SEQ ID NO: 2349 - protein, 273 aa, Artificial
  Nanobody sequence
EVQLVESGGGLVQAGGSLRLSCVVSGIPSTIRAMAWYRQAPGRQRDWVATIYSPSGSAVYADSVKGRFTISSDNAKKTIYLQMNSLKPDDTAVYYCRDVNREYWGQGTQVTVSSGGGGSGGGGSGGGGSGGGGSGGGGSGGGGSGGGGSEVQLVESGGSLVQPGGSLRLSCAASGFTFDDYAMSWVRQVPGKGLEWVSSINWSGTHTDYADSVKGRFTISRNNANNTLYLQMNSLKSEDTAVYYCAKNWRDAGTTWFEKSGSAGQGTQVTVSS

SEQ ID NO: 2350 - protein, 271 aa, Artificial
  Nanobody sequence
EVQLVESGGGLVQAGGSLNLSCVASGIPFSTRTMAWYRQPPGNERDWVATIRSGAPVYADSVKGRFTVSRDNAKNTLYLQMNSLEPEDTATYYCWDVNGDIWGQGTPVTVSSGGGGSGGGGSGGGGSGGGGSGGGGSGGGGSGGGGSEVQLVESGGSLVQPGGSLRLSCAASGFTFDDYAMSWVRQVPGKGLEWVSSINWSGTHTDYADSVKGRFTISRNNANNTLYLQMNSLKSEDTAVYYCAKNWRDAGTTWFEKSGSAGQGTQVTVSS

SEQ ID NO: 2351 - protein, 271 aa, Artificial; identical to SEQ ID NO: 2350
  Nanobody sequence

SEQ ID NO: 2352 - protein, 272 aa, Artificial
  Nanobody sequence
EVQLVESGGGLVQAGGSLRLSCVTSRRPASTRTMAWYRQAPGKQRDWVATISSHGLPVYADSVKGRFTVSRDNANNTVYLQMNTLKPEDTAVYYCRDVNADYWGQGTQVTVSSGGGGSGGGGSGGGGSGGGGSGGGGSGGGGSGGGGSEVQLVESGGSLVQPGGSLRLSCAASGFTFDDYAMSWVRQVPGKGLEWVSSINWSGTHTDYADSVKGRFTISRNNANNTLYLQMNSLKSEDTAVYYCAKNWRDAGTTWFEKSGSAGQGTQVTVSS

SEQ ID NO: 2353 - protein, 272 aa, Artificial
  Nanobody sequence
EVQLVESGGGLVQPGGSLRLSCAASRIPFSTRTMAWYRQAPGKQRDWVATIGTSGPPRYADSVKGRFTVSRDNAKNTVYLQMNSLKAEDTAVYYCWDVNADYWGQGTQVTVSSGGGGSGGGGSGGGGSGGGGSGGGGSGGGGSGGGGSEVQLVESGGSLVQPGGSLRLSCAASGFTFDDYAMSWVRQVPGKGLEWVSSINWSGTHTDYADSVKGRFTISRNNANNTLYLQMNSLKSEDTAVYYCAKNWRDAGTTWFEKSGSAGQGTQVTVSS

SEQ ID NO: 2354 - protein, 272 aa, Artificial
  Nanobody sequence
EVQLVESGGGLVQPGGSLRLSCVASRIPASIRTMAWYRQTPGNQRDWLATIGSSGTPAYADSVKGRFTVSRDNAKNTVYLQMNSLKPEDTAVYYCRDVNGDYWGQGTQVTVSSGGGGSGGGGSGGGGSGGGGSGGGGSGGGGSGGGGSEVQLVESGGSLVQPGGSLRLSCAASGFTFDDYAMSWVRQVPGKGLEWVSSINWSGTHTDYADSVKGRFTISRNNANNTLYLQMNSLKSEDTAVYYCAKNWRDAGTTWFEKSGSAGQGTQVTVSS

SEQ ID NO: 2355 - protein, 283 aa, Artificial
  Nanobody sequence
KVQLVESGGSLVPPGGSLRLSCAASGFTFDDYAMTWVRQAPGKGLEWVSSINWSGTHTDYTDSVKGRFTISRNNANNTLYLQMNSLKSEDTAVYYCAKNWGDAGTTWFEKSGSAGQGTQVTVSSGGGGSGGGGSGGGGSGGGGSGGGGSGGGGSGGGGSEVQLVESGGSLVQPGGSLRLSCAASGFTFDDYAMSWVRQVPGKGLEWVSSINWSGTHTDYADSVKGRFTISRNNANNTLYLQMNSLKSEDTAVYYCAKNWRDAGTTWFEKSGSAGQGTQVTVSS

SEQ ID NO: 2356 - protein, 271 aa, Artificial; identical to SEQ ID NO: 2350
  Nanobody sequence

SEQ ID NO: 2357 - protein, 283 aa, Artificial
  Nanobody sequence
EVQLVESGGSLVQPGGSLRLSCAASGFTFDDYAMTWVRQTPGKGLEWVSSINWSGTHTDYTDSVKGRFTISRNNANNTLYLQMNSLKSDDTAVYYCAKNWGDAGTTWFEKSGSAGPGTQVTVSSGGGGSGGGGSGGGGSGGGGSGGGGSGGGGSGGGGSEVQLVESGGSLVQPGGSLRLSCAASGFTFDDYAMSWVRQVPGKGLEWVSSINWSGTHTDYADSVKGRFTISRNNANNTLYLQMNSLKSEDTAVYYCAKNWRDAGTTWFEKSGSAGQGTQVTVSS

SEQ ID NO: 2358 - protein, 272 aa, Artificial; identical to SEQ ID NO: 2352
  Nanobody sequence

SEQ ID NO: 2359 - protein, 272 aa, Artificial; identical to SEQ ID NO: 2354
  Nanobody sequence

SEQ ID NO: 2360 - protein, 272 aa, Artificial; identical to SEQ ID NO: 2352
  Nanobody sequence

SEQ ID NO: 2361 - protein, 272 aa, Artificial; identical to SEQ ID NO: 2352
  Nanobody sequence

SEQ ID NO: 2362 - protein, 272 aa, Artificial; identical to SEQ ID NO: 2352
  Nanobody sequence

SEQ ID NO: 2363 - protein, 283 aa, Artificial
  Nanobody sequence
EVQLVESGGSLVQPGGSLRLSCAASGFTFDDYAMTWVRQASGKGLEWVSSINWSGTHTDYTDSVKGRFTISRNNANNTLYLQMNSLKSEDTAVYYCAKNWGDAGTTWFEKSGSAGQGTQVTVSSGGGGSGGGGSGGGGSGGGGSGGGGSGGGGSGGGGSEVQLVESGGSLVQPGGSLRLSCAASGFTFDDYAMSWVRQVPGKGLEWVSSINWSGTHTDYADSVKGRFTISRNNANNTLYLQMNSLKSEDTAVYYCAKNWRDAGTTWFEKSGSAGQGTQVTVSS

SEQ ID NO: 2364 - protein, 276 aa, Artificial
  Nanobody sequence
EVQLVESGGGLVQAGGSLRLSCVASKMTFMRYTMGWYRQAPGKQRDLVASIDASGGTNYADSVKGRFTISRDNAKNTVYLEMNSLKPEDTGVYYCNGRWDIVGAIWWGQGTQVTVSSGGGGSGGGGSGGGGSGGGGSGGGGSGGGGSGGGGSEVQLVESGGSLVQPGGSLRLSCAASGFTFDDYAMSWVRQVPGKGLEWVSSINWSGTHTDYADSVKGRFTISRNNANNTLYLQMNSLKSEDTAVYYCAKNWRDAGTTWFEKSGSAGQGTQVTVSS

SEQ ID NO: 2365 - protein, 287 aa, Artificial
  Nanobody sequence
EVQLVESGGGLVQAGGSLRLSCAASGFTFDDYGIGWFRQASGKEREGVSCITSSDGSTYYADSVKGRFTISSDNAKNTVYLQMNSLKPEDTAVYYCAALPFVCPSGSYSDYGDEYDYWGQGTQVTVSSGGGGSGGGGSGGGGSGGGGSGGGGSGGGGSGGGGSEVQLVESGGSLVQPGGSLRLSCAASGFTFDDYAMSWVRQVPGKGLEWVSSINWSGTHTDYADSVKGRFTISRNNANNTLYLQMNSLKSEDTAVYYCAKNWRDAGTTWFEKSGSAGQGTQVTVSS

SEQ ID NO: 2366 - protein, 272 aa, Artificial
  Nanobody sequence
EVQLVESGGGLVQAGGSLRLSCAASGIAFRIRTMAWYRQAPGKQRDWVATSDSGGTTLYADSVKGRFTVSRDNAENTVYLQMNSLKPEDTAVYYCRDVNRDYWGQGTQVTVSSGGGGSGGGGSGGGGSGGGGSGGGGSGGGGSGGGGSEVQLVESGGSLVQPGGSLRLSCAASGFTFDDYAMSWVRQVPGKGLEWVSSINWSGTHTDYADSVKGRFTISRNNANNTLYLQMNSLKSEDTAVYYCAKNWRDAGTTWFEKSGSAGQGTQVTVSS

SEQ ID NO: 2367 - protein, 272 aa, Artificial
  Nanobody sequence
EVQLVESGGGLVQAGGSLSLSCVASGRFFSTRVMAWYRQTPGKQREFVASMRGSGSTNYADSVRGRFAISRDNAKNTVYLQMNTLKPEDTAVYYCRDINEDQWGQGTQVTVSSGGGGSGGGGSGGGGSGGGGSGGGGSGGGGSGGGGSEVQLVESGGSLVQPGGSLRLSCAASGFTFDDYAMSWVRQVPGKGLEWVSSINWSGTHTDYADSVKGRFTISRNNANNTLYLQMNSLKSEDTAVYYCAKNWRDAGTTWFEKSGSAGQGTQVTVSS

SEQ ID NO: 2368 - protein, 272 aa, Artificial; identical to SEQ ID NO: 2352
  Nanobody sequence

SEQ ID NO: 2369 - protein, 271 aa, Artificial; identical to SEQ ID NO: 2350
  Nanobody sequence

SEQ ID NO: 2370 - protein, 283 aa, Artificial
  Nanobody sequence
EVQLVESGGSLVQPGGSLRLSCAASGFTFDDYAMSWVRQAPGKGLEWISSINWSGTHTDYADSVKGRFTISRNNANNTLYLQMNNLKFEDTAVYYCAKNWRDAGTTWFEKSGSAGQGTQVTVSSGGGGSGGGGSGGGGSGGGGSGGGGSGGGGSGGGGSEVQLVESGGSLVQPGGSLRLSCAASGFTFDDYAMSWVRQVPGKGLEWVSSINWSGTHTDYADSVKGRFTISRNNANNTLYLQMNSLKSEDTAVYYCAKNWRDAGTTWFEKSGSAGQGTQVTVSS

SEQ ID NO: 2371 - protein, 271 aa, Artificial
  Nanobody sequence
EVQLVESGGGLVQAGGSLRLSCVASGIPSIRAIAWYRQAPGKQRDWVATSGTGYGATYDDSVKGRFTLSRDNAKNTVYLQMNSLKPEDTAVYYCRDVNRDYWGQGTQVTVSSGGGGSGGGGSGGGGSGGGGSGGGGSGGGGSGGGGSEVQLVESGGSLVQPGGSLRLSCAASGFTFDDYAMSWVRQVPGKGLEWVSSINWSGTHTDYADSVKGRFTISRNNANNTLYLQMNSLKSEDTAVYYCAKNWRDAGTTWFEKSGSAGQGTQVTVSS

SEQ ID NO: 2372 - protein, 272 aa, Artificial
  Nanobody sequence
EVQLVESGGGLVQAGGSLRLPCAASGIAFRIRTMAWYRQAPGKQRDWVATSDSGGTTLYADSVKGRFTVSRDNAENTVYLQMNSLKPEDTAVYYCRDVNRDYWGQGTQVTVSSGGGGSGGGGSGGGGSGGGGSGGGGSGGGGSGGGGSEVQLVESGGSLVQPGGSLRLSCAASGFTFDDYAMSWVRQVPGKGLEWVSSINWSGTHTDYADSVKGRFTISRNNANNTLYLQMNSLKSEDTAVYYCAKNWRDAGTTWFEKSGSAGQGTQVTVSS

SEQ ID NO: 2373 - protein, 281 aa, Artificial
  Nanobody sequence
EVQLVESGGGLVQPGGSLRLSCAASGFTFSSYAMSWVRQAPGKGLEWVSAISSGGGSITTYADSVKGRFTISRDNAKNTLYLQMSSLKPEDTALYYCAKARSSSSYYDFGSWGQGTQVTVSSGGGGSGGGGSGGGGSGGGGSGGGGSGGGGSGGGGSEVQLVESGGSLVQPGGSLRLSCAASGFTFDDYAMSWVRQVPGKGLEWVSSINWSGTHTDYADSVKGRFTISRNNANNTLYLQMNSLKSEDTAVYYCAKNWRDAGTTWFEKSGSAGQGTQVTVSS

SEQ ID NO: 2374 - protein, 283 aa, Artificial; identical to SEQ ID NO: 2363
  Nanobody sequence

SEQ ID NO: 2375 - protein, 271 aa, Artificial; identical to SEQ ID NO: 2350
  Nanobody sequence

SEQ ID NO: 2376 - protein, 272 aa, Artificial
  Nanobody sequence
EVQLVESGGGLVQAGGSLRLSCAASGIAFRIRTMAWYRQAPGKQRDWVATSDSGGTTLYADSVKGRFTVSRDNADNTVYLQMNSLKPEDTAVYYCRDVNRDYWGQGTQVTVSSGGGGSGGGGSGGGGSGGGGSGGGGSGGGGSGGGGSEVQLVESGGSLVQPGGSLRLSCAASGFTFDDYAMSWVRQVPGKGLEWVSSINWSGTHTDYADSVKGRFTISRNNANNTLYLQMNSLKSEDTAVYYCAKNWRDAGTTWFEKSGSAGQGTQVTVSS

SEQ ID NO: 2377 - protein, 277 aa, Artificial
  Nanobody sequence
EVQLVESGGGLVQPGGSLRLSCVASGFSLDDYGMTWVRQAPGKGLEWVSSINWSGTHTDYADSVKGRFTISRDNAKNTLFLQMNSLTPEDTAVYYCNQGWKILPAERRGHGTQVTVSSGGGGSGGGGSGGGGSGGGGSGGGGSGGGGSGGGGSEVQLVESGGSLVQPGGSLRLSCAASGFTFDDYAMSWVRQVPGKGLEWVSSINWSGTHTDYADSVKGRFTISRNNANNTLYLQMNSLKSEDTAVYYCAKNWRDAGTTWFEKSGSAGQGTQVTVSS

SEQ ID NO: 2378 - protein, 274 aa, Artificial
  Nanobody sequence
EVQLVESGGGLVQPGGSLRLSCAASGLGIAFSRRTMAWYRQAPGKQRDWVATIAGDGSTVYADSMKGRFTISRDNAKNTVYLQVNSLKPEDTAVYYCWDTNGDYWGQGTQVTVSSGGGGSGGGGSGGGGSGGGGSGGGGSGGGGSGGGGSEVQLVESGGSLVQPGGSLRLSCAASGFTFDDYAMSWVRQVPGKGLEWVSSINWSGTHTDYADSVKGRFTISRNNANNTLYLQMNSLKSEDTAVYYCAKNWRDAGTTWFEKSGSAGQGTQVTVSS

SEQ ID NO: 2379 - protein, 274 aa, Artificial
  Nanobody sequence
EVQLMESGGGLVQPGGSLRLSCAASGLGIAFSRRTMAWYRQAPGKQRDWVATIAGDGSTVYADSMKGRFTISRDNAENTVYLQMNSLKPEDTAVYYCWDVNRDYWGQGTQVTVSSGGGGSGGGGSGGGGSGGGGSGGGGSGGGGSGGGGSEVQLVESGGSLVQPGGSLRLSCAASGFTFDDYAMSWVRQVPGKGLEWVSSINWSGTHTDYADSVKGRFTISRNNANNTLYLQMNSLKSEDTAVYYCAKNWRDAGTTWFEKSGSAGQGTQVTVSS

SEQ ID NO: 2380 - protein, 283 aa, Artificial
  Nanobody sequence
EVQLVESGGSLVQPGGSLRLSCAASGFTFDDYAMTWVRQASGKGLEWVSSINWSGTHTDYADSVKGRFTISRNNANNTLYLQMNSLKSEDTAVYYCAKNWGDAGTTWFEKSGSAGQGTQVTVSSGGGGSGGGGSGGGGSGGGGSGGGGSGGGGSGGGGSEVQLVESGGSLVQPGGSLRLSCAASGFTFDDYAMSWVRQVPGKGLEWVSSINWSGTHTDYADSVKGRFTISRNNANNTLYLQMNSLKSEDTAVYYCAKNWRDAGTTWFEKSGSAGQGTQVTVSS

SEQ ID NO: 2381 - protein, 277 aa, Artificial
  Nanobody sequence
EVQLVESGGGLVQPGGSLRLSCVASGFSLDDYGMTWVRQAPGKGLEWVSSINWSGTHTDYADSVKGRFTISRDNAKNTLFLQMNSLSPEDTAVYYCNQGWKILPTNRGSHGTQVTVSSGGGGSGGGGSGGGGSGGGGSGGGGSGGGGSGGGGSEVQLVESGGSLVQPGGSLRLSCAASGFTFDDYAMSWVRQVPGKGLEWVSSINWSGTHTDYADSVKGRFTISRNNANNTLYLQMNSLKSEDTAVYYCAKNWRDAGTTWFEKSGSAGQGTQVTVSS

SEQ ID NO: 2382 - protein, 277 aa, Artificial
  Nanobody sequence
EVQLVESGGGLVQPGGSLRLSCVASGFSLDDYGMTWVRQAPGKGLEWVSSINWSGTHTDYADSVKGRFTISRDNAKNTLFLQMNSLTPEDTAVYYCNQGWKIIPTDRRGHGTQVTVSSGGGGSGGGGSGGGGSGGGGSGGGGSGGGGSGGGGSEVQLVESGGSLVQPGGSLRLSCAASGFTFDDYAMSWVRQVPGKGLEWVSSINWSGTHTDYADSVKGRFTISRNNANNTLYLQMNSLKSEDTAVYYCAKNWRDAGTTWFEKSGSAGQGTQVTVSS

SEQ ID NO: 2383 - protein, 276 aa, Artificial
  Nanobody sequence
EVQLVESGGGLVQAGGSLRLSCAASGSTFSINRMAWYRQSPGKQRELVAAVDNDDNTEYSDSVAGRFTISRDNAKNAVHLQMNSLRLEDTAVYYCNAKQLPYLQNFWGQGTQVTVSSGGGGSGGGGSGGGGSGGGGSGGGGSGGGGSGGGGSEVQLVESGGSLVQPGGSLRLSCAASGFTFDDYAMSWVRQVPGKGLEWVSSINWSGTHTDYADSVKGRFTISRNNANNTLYLQMNSLKSEDTAVYYCAKNWRDAGTTWFEKSGSAGQGTQVTVSS

SEQ ID NO: 2384 - protein, 276 aa, Artificial
  Nanobody sequence
EVQLVESGGGLVQAGGSLRLSCAASGITFRRYDMGWYRQFPGKERELVATILSEGDTNYVDPVKGRFTISRDNAKNTVYLQMNDLKPEDTAVYYCNGVWRAIGRTYWGQGTQVTVSSGGGGSGGGGSGGGGSGGGGSGGGGSGGGGSGGGGSEVQLVESGGSLVQPGGSLRLSCAASGFTFDDYAMSWVRQVPGKGLEWVSSINWSGTHTDYADSVKGRFTISRNNANNTLYLQMNSLKSEDTAVYYCAKNWRDAGTTWFEKSGSAGQGTQVTVSS

SEQ ID NO: 2385 - protein, 283 aa, Artificial
  Nanobody sequence
EVQLVESGGSLVPPGGSLRLSCAASGFTFDDYAMSWVRQAPGKGLEWVSSINWSGTHTGYTDSVKGRFTISRNNANNTLYLQMNSLKSEDTAVYYCAKNWGDAGTTWFEKSGSAGQGTQVTVSSGGGGSGGGGSGGGGSGGGGSGGGGSGGGGSGGGGSEVQLVESGGSLVQPGGSLRLSCAASGFTFDDYAMSWVRQVPGKGLEWVSSINWSGTHTDYADSVKGRFTISRNNANNTLYLQMNSLKSEDTAVYYCAKNWRDAGTTWFEKSGSAGQGTQVTVSS

SEQ ID NO: 2386 - protein, 283 aa, Artificial
  Nanobody sequence
EVQLVESGGSLVQPGGSLRLSCAASGFTFDDYAMTWVRQAPGKGLEWVSSINWSGTHTDYTDSVKGRFTISRNNANNTLYLQMNSLKSEDTAVYYCAKNWGDAGTTWFEKSGSAGQGTQVTVSSGGGGSGGGGSGGGGSGGGGSGGGGSGGGGSGGGGSEVQLVESGGSLVQPGGSLRLSCAASGFTFDDYAMSWVRQVPGKGLEWVSSINWSGTHTDYADSVKGRFTISRNNANNTLYLQMNSLKSEDTAVYYCAKNWRDAGTTWFEKSGSAGQGTQVTVSS

SEQ ID NO: 2387 - protein, 283 aa, Artificial
  Nanobody sequence
EVQLVESGGSLVPPGGSLRLSCAASGFTFDDYGMSWVRQAPGKGLEWVSSINWSGTHTDYTDSVKGRFTISRNNANNTLYLQMNSLKSEDTAVYYCAKNWGDAGTTWFEKSGSAGQGTQVTVSSGGGGSGGGGSGGGGSGGGGSGGGGSGGGGSGGGGSEVQLVESGGSLVQPGGSLRLSCAASGFTFDDYAMSWVRQVPGKGLEWVSSINWSGTHTDYADSVKGRFTISRNNANNTLYLQMNSLKSEDTAVYYCAKNWRDAGTTWFEKSGSAGQGTQVTVSS

SEQ ID NO: 2388 - protein, 277 aa, Artificial; identical to SEQ ID NO: 2377
  Nanobody sequence

SEQ ID NO: 2389 - protein, 277 aa, Artificial
  Nanobody sequence
EVQLVESGGGLVQPGGSLRLSCVASGFSLDDYGMTWVRQAPGKGLEWVSSINWSGTHTDYADSVKGRFTISRDNAKNTLFLQMNNLTPEDTAVYYCNQGWKIIPTDRRGHGTQVTVSSGGGGSGGGGSGGGGSGGGGSGGGGSGGGGSGGGGSEVQLVESGGSLVQPGGSLRLSCAASGFTFDDYAMSWVRQVPGKGLEWVSSINWSGTHTDYADSVKGRFTISRNNANNTLYLQMNSLKSEDTAVYYCAKNWRDAGTTWFEKSGSAGQGTQVTVSS

SEQ ID NO: 2390 - protein, 277 aa, Artificial
  Nanobody sequence
EVQLVESGGGLVQPGGSLRLSCVGSGFSLDDYAMTWVRQAPGKGLEWVSSINWSGTHTDYADSVKGRFTISRDNAKNTLFLQMNSLSPEDTAVYYCNQGWKIRPTIPMGHGTQVTVSSGGGGSGGGGSGGGGSGGGGSGGGGSGGGGSGGGGSEVQLVESGGSLVQPGGSLRLSCAASGFTFDDYAMSWVRQVPGKGLEWVSSINWSGTHTDYADSVKGRFTISRNNANNTLYLQMNSLKSEDTAVYYCAKNWRDAGTTWFEKSGSAGQGTQVTVSS

SEQ ID NO: 2391 - protein, 115 aa, Artificial [sequence omitted]

SEQ ID NO: 2392 - DNA, 21 bp, Artificial
  Primer sequence
gcgagcacccaagtgtgcacc

SEQ ID NO: 2393 - DNA, 21 bp, Artificial
  Primer sequence
ctgctcggcggggcagccctt

SEQ ID NO: 2394 - DNA, 50 bp, Artificial
  Primer sequence
ggcgcgccgactacaaagacgatgacgacaagagcacccaagtgtgcacc

SEQ ID NO: 2395 - DNA, 51 bp, Artificial
  Primer sequence
cggctcgagctattaatgagaatggtgatggtgctcggcggggcagccctt

SEQ ID NO: 2396 - DNA, 15 bp, Artificial
  Primer sequence
tgattacgccaagct

SEQ ID NO: 2397 - DNA, 53 bp, Artificial
  Primer sequence
tgattacgccaagcttgcatgcaaattctatttcaaggagattttcaacatga

SEQ ID NO: 2398 - DNA, 54 bp, Artificial
  Primer sequence
gctggattgttattactcgcggcccagccggccatggccgacatccagatgacg

SEQ ID NO: 2399 - DNA, 50 bp, Artificial
  Primer sequence
gcgtccgtcggcgatcgcgttaccatcacatgcaaagcaagtcaggacgt

SEQ ID NO: 2400 - DNA, 50 bp, Artificial
  Primer sequence
atcaacagaagccgggcaaggctccgaaattgctcatttactccgcatca

SEQ ID NO: 2401 - DNA, 50 bp, Artificial
  Primer sequence
ttcccgtttcagcggaagcggctcgggtactgattttaccctgactatct

SEQ ID NO: 2402 - DNA, 50 bp, Artificial
  Primer sequence
ttcgccacctactattgtcagcaatactatatttacccgtatacctttgg

SEQ ID NO: 2403 - DNA, 50 bp, Artificial
  Primer sequence
attaaacgtacggtagctgcccctagcgtgtttatctttccgccttccga

SEQ ID NO: 2404 - DNA, 50 bp, Artificial
  Primer sequence
cggccagcgtcgtatgtttactgaataacttctatccgcgcgaagctaaa

SEQ ID NO: 2405 - DNA, 50 bp, Artificial
  Primer sequence
tgcactgcagtccggcaattctcaagaatccgtgacggaacaagatagca

SEQ ID NO: 2406 - DNA, 50 bp, Artificial
  Primer sequence
agctctaccctgaccttgtcaaaggcagattatgaaaaacacaaagttta

SEQ ID NO: 2407 - DNA, 45 bp, Artificial
  Primer sequence
ccatcagggactttcgagtccggttacaaagtcttttaaccgcgg

SEQ ID NO: 2408 - DNA, 53 bp, Artificial
  Primer sequence
taataacaatccagcggctgccgtaggcaataggtatttcatgttgaaaatct

SEQ ID NO: 2409 - DNA, 54 bp, Artificial
  Primer sequence
atcgccgacggacgcgctcaggctactcggagattgcgtcatctggatgtcggc

SEQ ID NO: 2410 - DNA, 50 bp, Artificial
  Primer sequence
ccggcttctgttgataccaagcaaccccgatagatacgtcctgacttgct

SEQ ID NO: 2411 - DNA, 50 bp, Artificial
  Primer sequence
ccgctgaaacgggaaggcacaccggtgtaacgatatgatgcggagtaaat

SEQ ID NO: 2412 - DNA, 50 bp, Artificial
  Primer sequence
atagtaggtggcgaagtcctctggctgcaggctagagatagtcagggtaa

SEQ ID NO: 2413 - DNA, 50 bp, Artificial
  Primer sequence
taccgtacgtttaatttccactttcgtaccctggccaaaggtatacgggt

SEQ ID NO: 2414 - DNA, 15 bp, Artificial
  Primer sequence
tcggaaggcggaaag

SEQ ID NO: 2415 - DNA, 50 bp, Artificial
  Primer sequence
atacgacgctggccgtaccacttttcagctgctcgtcggaaggcggaaag

SEQ ID NO: 2416 - DNA, 50 bp, Artificial
  Primer sequence
ccggactgcagtgcattatccactttccattggactttagcttcgcgcgg

SEQ ID NO: 2417 - DNA, 50 bp, Artificial
  Primer sequence
ggtcagggtagagctcagtgagtaagtgctatctttgctatcttgttccg

SEQ ID NO: 2418 - DNA, 45 bp, Artificial
  Primer sequence
gaaagtccctgatgggtcacttcacaggcgtaaactttgtgtttt

SEQ ID NO: 2419 - DNA, 46 bp, Artificial
  Primer sequence
aaatagaattggcgcgccttattagcactcaccgcggttaaaagac

SEQ ID NO: 2420 - DNA, 15 bp, Artificial
  Primer sequence
aaatagaattggcgc

SEQ ID NO: 2421 - DNA, 15 bp, Artificial
  Primer sequence
gtgctaataaggcgc

SEQ ID NO: 2422 - DNA, 50 bp, Artificial
  Primer sequence
gtgctaataaggcgcgccaattctatttcaaggagacagtcatagtgaaa

SEQ ID NO: 2423 - DNA, 50 bp, Artificial
  Primer sequence
tttagtggtacctttctattctcactccgaggttcagctggtggaaagcg

SEQ ID NO: 2424 - DNA, 50 bp, Artificial
  Primer sequence
ggcggttctctgcgtctgagctgcgctgcctccggtttcacgttcactga

SEQ ID NO: 2425 - DNA, 50 bp, Artificial
  Primer sequence
gccaggcgccgggtaaaggccttgaatgggtggccgacgtaaaccctaac

SEQ ID NO: 2426 - DNA, 50 bp, Artificial
  Primer sequence
ccaacgttttaagggtcgtttcaccctgagcgtagatcgctctaaaaaca

SEQ ID NO: 2427 - DNA, 50 bp, Artificial
  Primer sequence
tcgctgcgtgcagaagacaccgctgtttattactgtgcacgcaatctggg

SEQ ID NO: 2428 - DNA, 50 bp, Artificial
  Primer sequence
attggggccaaggcacgttggtcaccgtgagtagcgcaagcactaaaggt

SEQ ID NO: 2429 - DNA, 50 bp, Artificial
  Primer sequence
acctttagtgcttgcgctactcacggtgaccaacgtgccttggccccaat

SEQ ID NO: 2430 - DNA, 50 bp, Artificial
  Primer sequence
cccaagctcgaaatccacgtccggtggcaccgccgcgctgggctgtctgg

SEQ ID NO: 2431 - DNA, 50 bp, Artificial
  Primer sequence
ccggtcactgtctcctggaactcgggtgcacttacctcgggtgtacatac

SEQ ID NO: 2432 - DNA, 50 bp, Artificial
  Primer sequence
ctagcggcttgtatagcctgtcaagcgttgtgaccgtgccttcaagctct

SEQ ID NO: 2433 - DNA, 50 bp, Artificial
  Primer sequence
ttgcaatgtgaaccacaaaccgagtaacaccaaagtggataagaaagtgg

SEQ ID NO: 2434 - DNA, 50 bp, Artificial
  Primer sequence
aaaggtaccactaaaggaattgcgaataataattttttcactatgactgt

SEQ ID NO: 2435 - DNA, 50 bp, Artificial
  Primer sequence
acgcagagaaccgcctggctgcaccagcccacctccgctttccaccagct

SEQ ID NO: 2436 - DNA, 50 bp, Artificial
  Primer sequence
tttcacgttcactgattataccatggattgggttcgccaggcgccgggta

SEQ ID NO: 2437 - DNA, 50 bp, Artificial
  Primer sequence
cccttaaaacgttggttgtaaattgagccaccagagttagggtttacgtc

SEQ ID NO: 2438 - DNA, 50 bp, Artificial
  Primer sequence
ttctgcacgcagcgaattcatctgtaaatagagtgtgtttttagagcgat

SEQ ID NO: 2439 - DNA, 50 bp, Artificial
  Primer sequence
tgccttggccccaatagtcaaagtaaaaggacgggcccagattgcgtgca

SEQ ID NO: 2440 - DNA, 50 bp, Artificial
  Primer sequence
gatttcgagcttggggccagcggaaacactgacggacctttagtgcttgc

SEQ ID NO: 2441 - DNA, 15 bp, Artificial
  Primer sequence
gatttcgagcttggg

SEQ ID NO: 2442 - DNA, 50 bp, Artificial
  Primer sequence
ggagacagtgaccggttccgggaagtaatctttcaccagacagcccagcg

SEQ ID NO: 2443 - DNA, 50 bp, Artificial
  Primer sequence
tatacaagccgctagactgcaaaaccgcagggaaagtatgtacacccgag

SEQ ID NO: 2444 - DNA, 50 bp, Artificial
  Primer sequence
tggttcacattgcaaatatacgtctgggtgcccagagagcttgaaggcac

SEQ ID NO: 2445 - DNA, 47 bp, Artificial
  Primer sequence
tttttgttctgcggccgcacagctcttcggttccactttcttatcca

SEQ ID NO: 2446 - DNA, 15 bp, Artificial
  Primer sequence
tttttgttctgcggc

SEQ ID NO: 2447 - protein, 4 aa, Artificial Sequence
  GLEW group sequence
GLEW

SEQ ID NO: 2448 - protein, 4 aa, Artificial Sequence
  KERE group sequence
KERE

SEQ ID NO: 2449 - protein, 4 aa, Artificial Sequence
  KERE group sequence
KQRE

SEQ ID NO: 2450 - protein, 5 aa, Artificial Sequence
  KERE group sequence
KEREL

SEQ ID NO: 2451 - protein, 5 aa, Artificial Sequence
  KERE group sequence
KEREF

SEQ ID NO: 2452 - protein, 5 aa, Artificial Sequence
  KERE group sequence
KQREL

SEQ ID NO: 2453 - protein, 5 aa, Artificial Sequence
  KERE group sequence
KQREF

SEQ ID NO: 2454 - protein, 5 aa, Artificial Sequence
  KERE group Sequence
KEREG

SEQ ID NO: 2455 - protein, 4 aa, Artificial Sequence
  KERE group sequence
TERE

SEQ ID NO: 2456 - protein, 5 aa, Artificial Sequence
  KERE group sequence
TEREL

SEQ ID NO: 2457 - protein, 4 aa, Artificial Sequence
  KERE group sequence
KECE

SEQ ID NO: 2458 - protein, 5 aa, Artificial Sequence
  KERE group sequence
KECEL

SEQ ID NO: 2459 - protein, 5 aa, Artificial Sequence
  KERE group sequence
KECER

SEQ ID NO: 2460 - protein, 4 aa, Artificial Sequence
  KERE group sequence
RERE

SEQ ID NO: 2461 - protein, 5 aa, Artificial Sequence
  KERE group sequence
REREG

SEQ ID NO: 2462 - protein, 4 aa, Artificial Sequence
  KERE group sequence
QERE

SEQ ID NO: 2463 - protein, 5 aa, Artificial Sequence
  KERE group sequence
QEREG

SEQ ID NO: 2464 - protein, 4 aa, Artificial Sequence
  KERE group sequence
KGRE

SEQ ID NO: 2465 - protein, 5 aa, Artificial Sequence
  KERE group sequence
KGREG

SEQ ID NO: 2466 - protein, 4 aa, Artificial Sequence
  KERE group sequence
KDRE

SEQ ID NO: 2467 - protein, 5 aa, Artificial Sequence
  KERE group sequence
KDREV

SEQ ID NO: 2468 - protein, 5 aa, Artificial Sequence
  KERE group sequence
DECKL

SEQ ID NO: 2469 - protein, 5 aa, Artificial Sequence
  KERE group sequence
NVCEL

SEQ ID NO: 2470 - protein, 4 aa, Artificial Sequence
  GLEW group sequence
GVEW

SEQ ID NO: 2471 - protein, 4 aa, Artificial Sequence
  GLEW group sequence
EPEW

SEQ ID NO: 2472 - protein, 4 aa, Artificial Sequence
  GLEW group sequence
GLER

SEQ ID NO: 2473 - protein, 4 aa, Artificial Sequence
  GLEW group sequence
DQEW

SEQ ID NO: 2474 - protein, 4 aa, Artificial Sequence
  GLEW group sequence
DLEW

SEQ ID NO: 2475 - protein, 4 aa, Artificial Sequence
  GLEW group sequence
GIEW

SEQ ID NO: 2476 - protein, 4 aa, Artificial Sequence
  GLEW group sequence
ELEW

SEQ ID NO: 2477 - protein, 4 aa, Artificial Sequence
  GLEW group sequence
GPEW

SEQ ID NO: 2478 - protein, 4 aa, Artificial Sequence
  GLEW group sequence
EWLP

SEQ ID NO: 2479 - protein, 4 aa, Artificial Sequence
  GLEW group sequence
GPER

SEQ ID NO: 2480 - protein, 4 aa, Artificial Sequence
  GLEW group sequence
GLER

SEQ ID NO: 2481 - protein, 4 aa, Artificial Sequence
  GLEW group sequence
ELEW

SEQ ID NO: 2482 - protein, 4 aa, Artificial Sequence
  Microbody-like sequence
KLEW

The invention claimed is:

1. Isolated amino acid sequence that specifically binds HER2 and inhibits binding of trastuzumab to HER2, and that essentially consists of 4 framework regions (FR1 to FR4, respectively) and 3 complementarity determining regions (CDR1 to CDR3, respectively), in which:
   CDR1 is SEQ ID NO:462, and
   CDR2 is SEQ ID NO:1012, and
   CDR3 is SEQ ID NO:1562.

2. The amino acid sequence according to claim 1, that is a domain antibody, a single domain antibody, a VHH, a humanized VHH or a camelized VH.

3. The amino acid sequence according to claim 1, that essentially consists of a VHH, humanized VHH or camelized VH that has at least 80% amino acid identity with at least one of the amino acid sequences of SEQ ID NO's: 1 to 22 or 2051-232, in which for the purposes of determining the degree of amino acid identity, the amino acid residues that form the CDR sequences are disregarded.

4. The amino acid sequence according to claim 3, wherein one or more of the amino acid residues at positions 11, 37, 44, 45, 47, 83, 84, 103, 104 and 108 according to the Kabat numbering are chosen from:
   at position 11: L, M, S, V, W,
   at position 37: F, Y, H, I, L, V,
   at position 44: G, E, A, D, Q, R, S, L,
   at position 45: L, R, C, I, L, P, Q, V,
   at position 47: W, L, F, A, G, I, M, R, S, V, Y,
   at position 83: R, K, N, E, G, I, M, Q, T,
   at position 84: P, A, L, R, S, T, D, V,
   at position 103: W, P, R, S,
   at position 104: G, D, and
   at position 108: Q, L, R.

5. The amino acid sequence according to claim 1, that is SEQ ID NO:2112.

6. Isolated construct that comprises or essentially consists of one or more amino acid sequences according to claim 1, and further comprises one or more other groups, residues, moieties or binding units.

7. Construct according to claim 6, which is a multiparatopic construct, comprising at least one amino acid sequence that binds a first epitope of HER-2 and at least one amino acid sequence that binds a second epitope of HER-2 different from the first epitope.

8. Biparatopic construct according to claim 7, which can simultaneously bind the pertuzumab binding site on HER2 and to the trastuzumab binding site on HER2.

9. Construct according to claim 6, wherein said construct specifically binds the trastuzumab binding site on HER2 and specifically binds the pertuzumab binding site on HER2.

10. Construct according to claim 6, wherein said construct competes with trastuzumab and pertuzumab for binding to HER2 and/or wherein said construct inhibits binding of trastuzumab and pertuzumab to HER2.

11. Construct according to claim 6, that comprises or consists of one of SEQ ID NO's: 2346 or 2347.

12. Construct according to claim 6, which has an increased half-life, compared to the corresponding one or more amino acid sequences per se.

13. Construct according to claim 6 that is selected from any of SEQ ID NO's: 2330 and 2335.

14. Composition comprising at least one construct according to claim 6.

15. Monovalent construct, comprising or essentially consisting of one amino acid sequence according to claim 1.

16. Composition, comprising at least one amino acid sequence according to claim 1.

* * * * *

UNITED STATES PATENT AND TRADEMARK OFFICE
CERTIFICATE OF CORRECTION

PATENT NO. : 8,975,382 B2  
APPLICATION NO. : 12/744991  
DATED : March 10, 2015  
INVENTOR(S) : Hilde Adi Pierrette Revets et al.

Page 1 of 1

It is certified that error appears in the above-identified patent and that said Letters Patent is hereby corrected as shown below:

In the Claims:

Claim 3, starting at column 327, line 47, should read:

3. The amino acid sequence according to claim 1, that essentially consists of a VHH, humanized VHH or camelized VH that has at least 80% amino acid identity with at least one of the amino acid sequences of SEQ ID NO's: 1 to 22 or 2051-2325, in which for the purposes of determining the degree of amino acid identity, the amino acid residues that form the CDR sequences are disregarded.

Signed and Sealed this
Twenty-fourth Day of May, 2016

Michelle K. Lee
*Director of the United States Patent and Trademark Office*